US011111284B2

(12) United States Patent
Faustman et al.

(10) Patent No.: US 11,111,284 B2
(45) Date of Patent: Sep. 7, 2021

(54) TUMOR NECROSIS FACTOR SUPERFAMILY AND TNF-LIKE LIGAND MUTEINS AND METHODS OF PREPARING

(71) Applicant: The General Hospital Corporation, Boston, MA (US)

(72) Inventors: Denise L. Faustman, Boston, MA (US); Eva Vanamee, Boston, MA (US)

(73) Assignee: The General Hospital Corporation, Boston, MA (US)

( * ) Notice: Subject to any disclaimer, the term of this patent is extended or adjusted under 35 U.S.C. 154(b) by 48 days.

(21) Appl. No.: 15/504,968

(22) PCT Filed: Aug. 20, 2015

(86) PCT No.: PCT/US2015/046152
§ 371 (c)(1),
(2) Date: Feb. 17, 2017

(87) PCT Pub. No.: WO2016/029043
PCT Pub. Date: Feb. 25, 2016

(65) Prior Publication Data
US 2017/0260245 A1 Sep. 14, 2017

Related U.S. Application Data

(60) Provisional application No. 62/040,297, filed on Aug. 21, 2014.

(51) Int. Cl.
*C07K 14/52* (2006.01)
*C07K 14/525* (2006.01)
*A61K 38/19* (2006.01)
*A61K 38/00* (2006.01)
*A61K 38/17* (2006.01)
*A61K 38/22* (2006.01)
*A61K 45/06* (2006.01)
*C07K 14/575* (2006.01)
*C07K 14/705* (2006.01)

(52) U.S. Cl.
CPC .......... *C07K 14/525* (2013.01); *A61K 38/191* (2013.01); *C07K 14/5255* (2013.01); *A61K 38/00* (2013.01); *A61K 38/1793* (2013.01); *A61K 38/22* (2013.01); *A61K 45/06* (2013.01); *C07K 14/575* (2013.01); *C07K 14/70575* (2013.01); *C07K 14/70578* (2013.01)

(58) Field of Classification Search
None
See application file for complete search history.

(56) References Cited

U.S. PATENT DOCUMENTS 7,264,810 B2 * 9/2007 Renner ............... A61K 39/0005
424/185.1
7,446,174 B2 * 11/2008 Desjarlais ............ A61K 38/191
435/335

2003/0138401 A1 7/2003 Dahiyat et al.
2004/0258660 A1 * 12/2004 Klysner ............... C07K 14/525
424/85.1
2004/0265392 A1 12/2004 Tovar et al.
2012/0230911 A1 9/2012 Hsieh et al.
2013/0243723 A1 9/2013 Hadden et al.
2014/0096274 A1 4/2014 Quax et al.

FOREIGN PATENT DOCUMENTS

WO    WO-03/040307 A2    5/2003

OTHER PUBLICATIONS

Bodmer et al., JCysteine 230 is essential for the structure and activity of cytotoxic ligans TRAIL, J. Biol. Chem., 275(27:20632-37, 2000.*
Lees et al., The rold of cysteine residues in the folding and association of the COOH-terminal propeptide of types I and II procollagen, J. Biol. Chem. 269:24354-24360, 1994.*
Matsumura et al., Sabilization of phate T4 lysozyme by engineered disulfide bonds, Proc. Natl. Acad. Sci. USA, 86:6562-6566, 1989.*
Lamanna et al., The structure-function relationship of disulfide bonds in etanercept, Sci. Reports, 7:3951; 1-8, 2017.*
Bremer et al., Targeting of the tumor necrosis factor receptor superfamily for cancer immunotherapy, ISRN Oncol. vol. 2103, Article ID 371854, 25 pages, 2013.*
Black et al., A metalloproteinase disintegrin that releases tumour-necrosis factor-alpha from cells, Nature, 385(6618):729-733, Feb. 1997.*
Krauss et al., An overview of biological macromolecule crystallization, Int. J. Mol. Sci. 14:10643-11691, 2013.*
Zhan et al., Biochemical and structural characterization of the human TL1A ectodomain, Biochem. 48:7636-7645, 2009.*
Liu et al., Structural and functaion linsights of RANKL-RANK interaction and signaling, J. Immunol. 184(12):6910-6919, Jun. 15, 2010.*
Compaan et al., The crystal structure of the costimulatory OX40-OX40Lcomplex,Structure, 14:1321-1330, Aug. 2006.I.*
T.E. Creighton, PROTEINS: Structures and molecular principles, (W.H. Freeman & Co.:New York), pp. 223-227,1984.*

(Continued)

*Primary Examiner* — Claire Kaufman
(74) *Attorney, Agent, or Firm* — Clark & Elbing LLP

(57) ABSTRACT

The invention features homo-multimers, e.g., homo-trimers, of TNFSF or TNF-like ligand muteins in which each TNFSF ligand or TNF-like ligand mutein monomer contains at least one cysteine residue substitution or insertion that promotes the formation of a disulfide bond with a cysteine residue on a neighboring TNFSF or TNF-like ligand mutein monomer. The invention features methods of producing such TNFSF and TNF-like ligand muteins, pharmaceutical compositions containing such muteins, and methods of using such muteins in cancer immunotherapy, in treating autoimmune and neurological diseases, and in reducing or eliminating the complications and risks of rejection in organ transplantation or tissue or organ repair or regeneration.

14 Claims, 3 Drawing Sheets
Specification includes a Sequence Listing.

(56) References Cited

OTHER PUBLICATIONS

Extended European Search Report for European Application No. 15833686.7, dated Aug. 8, 2018 (13 pages).
Mackay et al., "TNF ligands and receptors in autoimmunity: an update," Curr Opin Immunol. 14(6):783-90 (2002).
Supplementary Partial European Search Report for European Application No. 15833686.7, dated May 4, 2018 (16 pages).
International Search Report and Written Opinion for International Application No. PCT/US15/46152, dated Jan. 29, 2016 (22 pages).
Invitation to Pay Additional Fees for International Application No. PCT/US15/46152, dated Nov. 4, 2015 (4 pages).
Nielsen et al., "Insertion of foreign T cell epitopes in human tumor necrosis factor alpha with minimal effect on protein structure and biological activity," J Biol Chem. 279(32):33593-600 (2004).
Uniprot Entry P01375 TNFA_HUMAN, Jul. 21, 1986, <http://www.uniprot.org/uniprot/P01375>, retrieved Jan. 4, 2016 (18 pages).
International Preliminary Report on Patentability for International Patent Application No. PCT/US2015/046152, dated Feb. 21, 2017 (10 pages).
Eck et al., "The Structure of Tumor Necrosis Factor-alpha at 2.6 A Resolution: Implications for Receptor Binding," J Biol Chem. 264(29):17595-605 (1989).
Siurkus et al., "Reducing conditions are the key for efficient production of active ribonuclease inhibitor in *Escherichia coli*," Microb Cell Fact. 10:31 (2011) (15 pages).
De Marco et al., "Native folding of aggregation-prone recombinant proteins in *Escherichia coli* by osmolytes, plasmid- or benzyl alcohol-overexpressed molecular chaperones," Cell Stress Soc. 10:4 (2005) (11 pages).

\* cited by examiner (adapted from Bremer, *ISRN Oncology* 2013:371854, 2013)

US 11,111,284 B2

TUMOR NECROSIS FACTOR SUPERFAMILY AND TNF-LIKE LIGAND MUTEINS AND METHODS OF PREPARING

SEQUENCE LISTING

This application contains a Sequence Listing submitted electronically in ASCII format and is hereby incorporated by reference in its entirety. Said ASCII copy, created Feb. 17, 2017, is named Sequence_Listing_21717_ST25.TXT and is 1,707,033 bytes in size.

BACKGROUND

The tumor necrosis factor superfamily (TNFSF) refers to a group of ligands, e.g., cytokines, that have diverse functions in the immune system. The TNFSF ligands, such as TNF-α, lymphotoxin (e.g., LT-α and LT-β), CD40L, CD70, CD153, OX40 ligand (OX40L), Fas ligand (FasL), 4-1BB ligand (4-1BBL), TRAIL, RANKL, TWEAK, APRIL, BLys, LIGHT, TL1, GITRL (also known as TL6), and EDA (e.g., EDA-A1 and EDA-A2), are structurally related ligands that bind to one or more receptors of the TNFSF. Ligands of the TNFSF are typically expressed as type II transmembrane proteins, which can be proteolytically cleaved so that the extracellular domain is released as a soluble protein (FIG. 1). Both the transmembrane and soluble portions of the TNFSF ligands form non-covalent homo-multimers, e.g., homo-trimers, in order to bind to their respective receptors to exert their biological functions. However, because of the high dissociation rate of soluble TNFSF ligands at low concentrations, soluble TNFSF ligands are often degraded and removed from the body. Various methods of secondary cross-linking of TNFSF ligands have been explored to increase the half-life and to improve signaling of these proteins (see, e.g., U.S. Patent Publication NO: US20030064480). However, these methods have significant shortcomings, including, e.g., the generation of a severe immunogenic effect caused by long and intrusive linker sequences between monomeric TNFSF ligands. There exists a need for stable and soluble ligands of various TNFSF receptors that have improved half-life and signaling activities.

TNF-like ligands are ligands that have similar folding topologies, key amino acid residue conservations, and intron positions as those of the TNFSF ligands. TNF-like ligands include complement-1q (C1q) family of proteins (also known as TNF-related family of proteins), e.g., adiponectin, myonectin, complement-1q tumor necrosis factor-related protein 3 (C1QTNF3), and C1QTNF5. C1q family of proteins can target receptors on muscle or liver cells. TNFSF ligands and TNF-like ligands display diverse functions in cell proliferation, inflammation, apoptosis, and morphogenesis. There exists a need for stable TNFSF and TNF-like ligands for therapeutic use and methods that can be used to generate stable TNFSF and TNF-like ligands.

SUMMARY OF THE INVENTION

TNFSF or TNF-like ligand muteins of the invention contain at least one surface-exposed (e.g., an exterior facing) cysteine residue substitution or insertion, which promotes the formation of a disulfide bond with another cysteine residue on a neighboring TNFSF or TNF-like ligand mutein. Multimers of TNFSF or TNF-like ligand muteins of the invention are composed of two, three, four, or more, in particular three, TNFSF or TNF-like ligand monomers or fragments thereof. TNFSF or TNF-like ligand muteins may bind to one or more TNFSF or TNF-like ligand receptors and exhibit longer half-life and improved signaling activities compared to a natural, non-covalently cross-linked TNFSF or TNF-like ligand counterpart. Furthermore, disulfide bonded multimers of TNFSF or TNF-like ligand muteins of the invention can effectively modulate ligand receptor interactions. Also included in the invention are methods of manufacturing TNFSF or TNF-like ligand muteins and pharmaceutical compositions containing such muteins. Pharmaceutical compositions containing TNFSF or TNF-like ligand muteins of the invention may be used for the treatment of autoimmune diseases, neurological diseases, cancers, infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In a first aspect, the invention features a polypeptide including all or a portion of a tumor necrosis factor superfamily (TNFSF) or TNF-like ligand in which the polypeptide includes at least one substitution of a surface-exposed, exterior-facing amino acid residue of the TNFSF or TNF-like ligand with a cysteine residue or at least one insertion of a cysteine residue within the region of surface-exposed, exterior-facing amino acid residues of the TNFSF or TNF-like ligand. In some embodiments, the polypeptide includes two substitutions of surface-exposed, exterior-facing amino acid residues of the TNFSF or TNF-like ligand with cysteine residues. In other embodiments, the polypeptide includes three or four substitutions of surface-exposed amino acid residues of the TNFSF or TNF-like ligand with cysteine residues. In some embodiments, the polypeptide includes two insertions of cysteine residues within the region of surface-exposed, exterior-facing amino acid residues of the TNFSF or TNF-like ligand. In other embodiments, the polypeptide includes three or four insertions of cysteine residues within the region of surface-exposed, exterior-facing amino acid residues of the TNFSF or TNF-like ligand. In all embodiments of the first aspect, the TNFSF or TNF-like ligand can be a soluble polypeptide that lacks one or both of the transmembrane and cytoplasmic domains of the TNFSF or TNF-like ligand. In other embodiments, a naturally occurring cysteine residue of a TNFSF or TNF-like ligand may be substituted to a non-cysteine residue, e.g., a serine, to avoid undesired dimer or multimer formation caused by, e.g., non-specific disulfide bond formation, or to eliminate a naturally occurring cysteine residue that forms a disulfide bond in the wild-type TNFSF or TNF-like ligand.

In this first aspect, the TNFSF or TNF-like ligand is TNF-α, lymphotoxin (e.g., LT-α and LT-β), CD40L, CD70, CD153, OX40L, FasL, 4-1BB ligand, TRAIL, RANKL, TWEAK, APRIL, BLys, LIGHT, TL1, GITRL (also known as TL6), EDA (e.g., EDA-A1 and EDA-A2), or adiponectin.

In some embodiments, the TNFSF ligand is TNF-α. In some embodiments, the polypeptide is a TNF-α mutein that includes all or a portion of TNF-α and has one, two, three, four, or more of the following cysteine substitutions: R82C, T83C, P84C, S85C, H91C, N110C, G130C, L131C, Y135C, N168C, L169C, L170C, S171C, A172C, I173C, K174C, S175C, Q178C, E180C, W190C, Y191C, P193C, G198C, V199C, F200C, Q201C, S223C, G224C, and Q225C, relative to the amino acid sequence of SEQ ID NO: 1. In other embodiments, the polypeptide is a TNF-α mutein that includes all or a portion of TNF-α and has one or more (preferably one) of the following pairs of cysteine substitutions: G130C/S85C, L131C/T83C, L131C/P84C, S171C/G224C, N168C/S223C, N168C/G224C, L169C/S223C, L169C/G224C, L170C/S223C, S171C/S223C, S171C/Q225C, A172C/P193C, I173C/Y191C, I173C/P193C, K174C/W191C, S175C/W190C, S175C/Y191C, Q178C/E180C, G198C/Y135C, V199C/H91C, F200C/H91C, F200C/N110C, Q201C/R82C, and Q201C/T83C, relative to the amino acid sequence of SEQ ID NO: 1. In yet other embodiments, the polypeptide is a TNF-α mutein that includes all or a portion of TNF-α and has at least one cysteine substitution or insertion within one or more, and preferably at least two, of the following amino acid regions: amino acids 77-94, 107-113, 127-138, 165-204, and 220-228, relative to the amino acid sequence of SEQ ID NO: 1 (e.g., one cysteine substitution or insertion within two different regions). In some embodiments, each TNF-α mutein or fragment thereof has at least one cysteine substitution or insertion (e.g., 2, 3, 4, or more cysteine substitution or insertion, preferably 2) and has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 1-39 and 624-638.

In some embodiments, the polypeptide is a TNF-α mutein that includes all or a portion of TNF-α and has the cysteine substitutions S171C and G224C, relative to the amino acid sequence of SEQ ID NO: 1. In some embodiments, the TNF-α mutein binds to a TNF receptor. In other embodiments, the TNF-α mutein binds to TNF receptor 1 (TNFR1) or TNF receptor 2 (TNFR2). In particular, the TNF-α mutein specifically binds to TNFR2. Preferably, the TNF-α mutein is a TNFR2-specific agonist. In some embodiments, the TNF-α mutein promotes TNFR2 multimerization. Preferably, the TNF-α mutein is a soluble polypeptide that lacks one or both of the transmembrane and cytoplasmic domains of the TNF-α.

In other embodiments, the TNF-α mutein is fused to a cancer-specific antibody (e.g., for use in targeted delivery and treatment of cancers expressing an antigen that is specifically bound by the cancer-specific antibody).

In other embodiments, the TNF-α mutein is an antagonist of TNFR2.

In some embodiments, the TNFSF ligand is LT-α. In some embodiments, the soluble polypeptide is an LT-α mutein that includes all or a portion of LT-α and has one, two, three, four, or more of the following cysteine substitutions: H66C, R85C, Y110C, P147C, L148C L149C, S150C, S151C, Q152C, K153C, M154C, W163C, L164C, S166C, A171C, A172C, F173C, P195C, S196C, and T197C, relative to the amino acid sequence of SEQ ID NO: 40. In other embodiments, the soluble polypeptide is an LT-α mutein that includes all or a portion of LT-α and has one or more (preferably one) of the following pairs of cysteine substitutions: P147C/P195C, P147C/S196C, L148C/P195C, L148C/S196C, L149C/P195C, S150C/S196C, S150C/P195C, S150C/T197C, S151C/S166C, Q152C/L164C, Q152C/S166C, K153C/L164C, M154C/W163C, M154C/L164C, A171C/Y110C, A172C/H66C, F173C/H66C, and F173C/R85C, relative to the amino acid sequence of SEQ ID NO: 40. In yet other embodiments, the polypeptide is an LT-α mutein that includes all or a portion of LT-α and has at least one cysteine substitution or insertion within one or more, and preferably at least two, of the following amino acid regions: amino acids 52-69, 82-88, 107-113, 144-176, and 192-200, relative to the amino acid sequence of SEQ ID NO: 40 (e.g., one cysteine substitution or insertion within two different regions). In some embodiments, each LT-α mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 40-75.

In some embodiments, the TNFSF ligand is LT-β. In some embodiments, the soluble polypeptide is an LT-β mutein that includes all or a portion of LT-β and has one, two, three, four, or more of the following cysteine substitutions: H91C, Q110C, Y136C, L177C, L178C, L179C, E180C, G181C, A182C, E183C, T184C, W201C, Y202C, S204C, G209C, L210C, V211C, R233C, G234C, and K235C, relative to the amino acid sequence of SEQ ID NO: 76. In other embodiments, the soluble polypeptide is an LT-β mutein that includes all or a portion of LT-β and has one or more (preferably one) of the following pairs of cysteine substitutions: L177C/R233C, L177C/G234C, L178C/R233C, L178C/G234C, L179C/R233C, E180C/R233C, E180C/G234C, E180C/K235C, G181C/S204C, A182C/Y202C, A182C/S204C, E183C/Y202C, T184C/W201C, T184C/Y202C, G209C/Y136C, L210C/H91C, V211C/H91C, and V211C/Q110C, relative to the amino acid sequence of SEQ ID NO: 76. In yet other embodiments, the polypeptide is an LT-β mutein that includes all or a portion of LT-β and has at least one cysteine substitution or insertion within one or more, and preferably at least two, of the following amino acid regions: amino acids 77-94, 107-113, 133-139, 174-187, 199-214, and 230-238, relative to the amino acid sequence of SEQ ID NO: 76 (e.g., one cysteine substitution or insertion within two different regions). In some embodiments, each LT-β mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 76-111.

In some embodiments, the TNFSF ligand is OX40 ligand (OX40L). In some embodiments, the soluble polypeptide is an OX40L mutein that includes all or a portion of OX40L and has one, two, three, four, or more of the following cysteine substitutions: K63C, S104C, P125C, L126C, Q128C, L129C, K130C, S134C, M139C, V140C, A141C, N166C, and G167C, relative to the amino acid sequence of SEQ ID NO: 112. In some embodiments, the soluble polypeptide is an OX40L mutein that includes all or a portion of OX40L and has one or more (preferably one) of the following pairs of cysteine substitutions: P125C/N166C, L126C/N166C, Q128C/N166C, Q128C/G167C, L129C/S134C, K130C/S134C, M139C/S104C, V140C/K63C, and A141C/K63C, relative to the amino acid sequence of SEQ ID NO: 112. In yet other embodiments, the polypeptide is an OX40L mutein that includes all or a portion of OX40L and has at least one cysteine substitution or insertion within one or more, and preferably at least two, of the following amino acid regions: amino acids 49-66, 101-107, 122-144, and 163-170, relative to the amino acid sequence of SEQ ID NO: 112 (e.g., one cysteine substitution or insertion within two different regions). In some embodiments, each OX40L mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 112-131 and 645-647.

In some embodiments, the TNFSF ligand is CD40L. In some embodiments, the soluble polypeptide is a CD40L mutein that includes all or a portion of CD40L and has one, two, three, four, or more of the following cysteine substitutions: H125C, Y145C, Y172C, I204C, L205C, L206C, R207C, A208C, A209C, N210C, T211C, S213C, K216C, P217C, G219C, Q220C, S222C, G227C, V228C, F229C, T251C, G252C, and F253C, relative to the amino acid sequence of SEQ ID NO: 132. In some embodiments, the soluble polypeptide is a CD40L mutein that includes all or a portion of CD40L and has one or more (preferably one) of the following pairs of cysteine substitutions: I204C/T251C, I204C/G252C, L205C/T251C, L205C/G252C, L206C/T251C, R207C/T251C, R207C/G252C, R207C/F253C, A208C/S222C, A209C/Q220C, A209C/S222C, N210C/Q220C, T211C/G219C, T211C/Q220C, S213C/K216C, S213C/P217C, G227C/Y172C, V228C/H125C, F229C/H125C, and F229C/Y145C, relative to the amino acid sequence of SEQ ID NO: 132. In yet other embodiments, the polypeptide is a CD40L mutein that includes all or a portion of CD40L and has at least one cysteine substitution or insertion within one or more, and preferably at least two, of the following amino acid regions: amino acids 111-128, 142-148, 169-175, 201-232, and 248-256, relative to the amino acid sequence of SEQ ID NO: 132 (e.g., one cysteine substitution or insertion within two different regions). In some embodiments, each CD40L mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 132-166, 620, 648-650, and 723-727.

In some embodiments, the TNFSF ligand is FasL. In some embodiments, the soluble polypeptide is a FasL mutein that includes all or a portion of FasL and has one, two, three, four, or more of the following cysteine substitutions: H148C, I168C, Y192C, V223C, M224C, M225C, E226C, G227C, K228C, M229C, M230C, W239C, A240C, S242C, A247C, V248C, F249C, E271C, S272C, and Q273C, relative to the amino acid sequence of SEQ ID NO: 167. In some embodiments, the soluble polypeptide is a FasL mutein that includes all or a portion of FasL and has one or more (preferably one) of the following pairs of cysteine substitutions: V223C/E271C, V223C/S272C, M224C/E271C, M224C/S272C, M225C/E271C, E226C/E271C, E226C/S272C, E226C/Q273C, G227C/S242C, K228C/A240C, K228C/S242C, M229C/A240C, M230C/W239C, M230C/A240C, A247C/Y192C, V248C/H148C, F249C/H148C, and F249C/I168C, relative to the amino acid sequence of SEQ ID NO: 167. In yet other embodiments, the polypeptide is a FasL mutein that includes all or a portion of FasL and has at least one cysteine substitution or insertion within one or more, and preferably at least two, of the following amino acid regions: amino acids 134-151, 165-171, 189-195, 220-252, and 268-276, relative to the amino acid sequence of SEQ ID NO: 167 (e.g., one cysteine substitution or insertion within two different regions). In some embodiments, each FasL mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 167-202 and 651-653.

In some embodiments, the TNFSF ligand is CD153. In some embodiments, the soluble polypeptide is a CD153 mutein that includes all or a portion of CD153 and has one, two, three, four, or more of the following cysteine substitutions: Y101C, I142C, C151S, A172C, L173C, V174C, T175C, V176C, E178C, S179C, V186C, Y187C, N189C, L194C, L195C, D196C, P220C, L221C, and E222C, relative to the amino acid sequence of SEQ ID NO: 236. In some embodiments, the soluble polypeptide is a CD153 mutein that includes all or a portion of CD153 and has one or more (preferably one) of the following pairs of cysteine substitutions: A172C/P220C, A172C/L221C, L173C/P220C, L173C/L221C, V174C/P220C, T175C/P220C, T175C/L221C, T175C/E222C, V176C/N189C, E178C/Y187C, S179C/V186C, S179C/Y187C, Y187C/C151S, N189C/C151S, L194C/I142C, L195C/Y101C, and D196C/Y101C, relative to the amino acid sequence of SEQ ID NO: 236. In yet other embodiments, the polypeptide is a CD153 mutein that includes all or a portion of CD153 and has at least one cysteine substitution or insertion within one or more, and preferably at least two, of the following amino acid regions: amino acids 86-104, 169-199, and 217-225, relative to the amino acid sequence of SEQ ID NO: 236 (e.g., one cysteine substitution or insertion within two different regions). In some embodiments, each CD153 mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 236-266. In some embodiments, a naturally occurring cysteine residue of a CD153 mutein, e.g., residue C151, may be mutated to a serine residue in order to avoid undesired dimerization.

In some embodiments, the TNFSF ligand is 4-1BB ligand. In some embodiments, the soluble polypeptide is a 4-1BB ligand mutein that includes all or a portion of 4-1BB ligand and has one, two, three, four, or more of the following cysteine substitutions: Q94C, L115C, F144C, A178C, L179C, L181C, T182C, V183C, D184C, L185C, N194C, S195C, F197C, R202C, L203C, L204C, G231C, and A232C, relative to the amino acid sequence of SEQ ID NO: 267. In some embodiments, the soluble polypeptide is a 4-1BB ligand mutein that includes all or a portion of 4-1BB ligand and has one or more (preferably one) of the following pairs of cysteine substitutions: A178C/G231C, L179C/G231C, L181C/G231C, L181C/A232C, T182C/F197C, V183C/S195C, V183C/F197C, D184C/S195C, L185C/N194C, L185C/S195C, R202C/F144C, L203C/Q94C, L204C/Q94C, and L204C/L115C, relative to the amino acid sequence of SEQ ID NO: 267. In yet other embodiments, the polypeptide is a 4-1BB ligand mutein that includes all or a portion of 4-1BB ligand and has at least one cysteine substitution or insertion within one or more, and preferably at least two, of the following amino acid regions: amino acids 80-97, 112-118, 175-207, and 228-235, relative to the amino acid sequence of SEQ ID NO: 267 (e.g., one cysteine substitution or insertion within two different regions). In some embodiments, each 4-1BB ligand mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 267-296 and 731-733.

In some embodiments, the TNFSF ligand is TRAIL. In some embodiments, the soluble polypeptide is a TRAIL mutein that includes all or a portion of TRAIL and has one, two, three, four, or more of the following cysteine substitutions: H125C, L147C, H161C, Y185C, L221C, L222C, M223C, K224C, S225C, A226C, R227C, N228C, C230S, G238C, L239C, S241C, G246C, I247C, H270C, E271C, and A272C, relative to the amino acid sequence of SEQ ID NO: 297. In some embodiments, the soluble polypeptide is a TRAIL mutein that includes all or a portion of TRAIL and has one or more (preferably one) of the following pairs of cysteine substitutions: L221C/H270C, L221C/E271C, L222C/H270C, L222C/E271C, M223C/H270C, K224C/H270C, K224C/E271C, K224C/A272C, S225C/S241C, A226C/L239C, A226C/S241C, R227C/L239C, N228C/G238C, N228C/L239C, G246C/Y185C, I247C/H125C, and L147C/H161C, relative to the amino acid sequence of SEQ ID NO: 297. In yet other embodiments, the polypeptide is a TRAIL mutein that includes all or a portion of TRAIL and has at least one cysteine substitution or insertion within one or more, and preferably at least two, of the following amino acid regions: amino acids 111-128, 144-150, 158-164, 182-188, 218-250, and 267-275, relative to the amino acid sequence of SEQ ID NO: 297 (e.g., one cysteine substitution or insertion within two different regions). In some embodiments, each TRAIL mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 297-332, 621, 623, 660-662, and 734. In some embodiments, a naturally occurring cysteine residue of a TRAIL mutein, e.g., residue C230, may be mutated to a serine residue in order to avoid undesired dimerization.

In some embodiments, the TNFSF ligand is RANKL. In some embodiments, the soluble polypeptide is a RANKL mutein that includes all or a portion of RANKL and has one, two, three, four, or more of the following cysteine substitutions: H167C, W193C, Y217C, T254C, L255C, M256C, K257C, G258C, G259C, S260C, W264C, G266C, H271C, F272C, S274C, G279C, F280C, F281C, Q303C, D304C, and A305C, relative to the amino acid sequence of SEQ ID NO: 333. In some embodiments, the soluble polypeptide is a RANKL mutein that includes all or a portion of RANKL and has one or more (preferably one) of the following pairs of cysteine substitutions: T254C/Q303C, T254C/D304C, L255C/Q303C, L255C/D304C, M256C/Q303C, K257C/O303C, K257C/D304C, K257C/A305C, G258C/S274C, G259C/F272C, G259C/S274C, S260C/H271C, S260C/F272C, W264C/G266C, G279C/Y217C, F280C/H167C, F281C/H167C, and F281C/W193C, relative to the amino acid sequence of SEQ ID NO: 333. In yet other embodiments, the polypeptide is a RANKL mutein that includes all or a portion of RANKL and has at least one cysteine substitution or insertion within one or more, and preferably at least two, of the following amino acid regions: amino acids 153-170, 190-196, 214-220, 251-284, and 300-308, relative to the amino acid sequence of SEQ ID NO: 333 (e.g., one cysteine substitution or insertion within two different regions). In some embodiments, each RANKL mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 333-368 and 622.

In some embodiments, the TNFSF ligand is TWEAK. In some embodiments, the soluble polypeptide is a TWEAK mutein that includes all or a portion of TWEAK and has one, two, three, four, or more of the following cysteine substitutions: Y164C, L187C, A188C, L189C, R190C, L192C, E193C, E194C, O206C, L207C, L209C, R208C, S213C, G214C, P238C, F239C, and L240C, relative to the amino acid sequence of SEQ ID NO: 369. In some embodiments, the soluble polypeptide is a TWEAK mutein that includes all or a portion of TWEAK and has one or more (preferably one) of the following pairs of cysteine substitutions: Y164C/S213C, Y164C/G214C, L187C/P238C, L187C/F239C, A188C/P238C, A188C/F239C, L189C/P238C, R190C/P238C, R190C/F239C, R190C/L240C, L192C/L207C, L192C/L209C, E193C/R208C, E194C/O206C, and E194C/L207C, relative to the amino acid sequence of SEQ ID NO: 369. In yet other embodiments, the polypeptide is a TWEAK mutein that includes all or a portion of TWEAK and has at least one cysteine substitution or insertion within one or more, and preferably at least two, of the following amino acid regions: amino acids 96-105, 161-167, 184-197, 204-217, and 235-243, relative to the amino acid sequence of SEQ ID NO: 369 (e.g., one cysteine substitution or insertion within two different regions). In some embodiments, each TWEAK mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 369-397.

In some embodiments, the TNFSF ligand is APRIL. In some embodiments, the soluble polypeptide is a APRIL mutein that includes all or a portion of APRIL and has one, two, three, four, or more of the following cysteine substitutions: H119C, F127C, A141C, Y166C, T192C, L193C, F194C, R195C, I197C, R198C, S199C, A207C, Y208C, S210C, C211S, G215C, V216C, F217C, P240C, H241C, and G242C, relative to the amino acid sequence of SEQ ID NO: 398. In some embodiments, the soluble polypeptide is a APRIL mutein that includes all or a portion of APRIL and has one or more (preferably one) of the following pairs of cysteine substitutions: T192C/P240C, T192C/H241C, L193C/P240C, L193C/H241C, F194C/P240C, R195C/P240C, R195C/H241C, R195C/G242C, I197C/Y208C, I197C/S210C, R198C/Y208C, S199C/A207C, S199C/Y208C, S210C/C211S, G215C/Y166C, V216C/H119C, F217C/H119C, and F127C/A141C, relative to the amino acid sequence of SEQ ID NO: 398. In yet other embodiments, the polypeptide is a APRIL mutein that includes all or a portion of APRIL and has at least one cysteine substitution or insertion within one or more, and preferably at least two, of the following amino acid regions: amino acids 105-130, 138-144, 163-169, 189-220, and 237-245, relative to the amino acid sequence of SEQ ID NO: 398 (e.g., one cysteine substitution or insertion within two different regions). In some embodiments, each APRIL mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 398-434.

In some embodiments, the TNFSF ligand is BLys. In some embodiments, the soluble polypeptide is a BLys mutein that includes all or a portion of BLys and has one, two, three, four, or more of the following cysteine substitutions: Q148C, Y196C, T228C, L229C, F230C, R231C, I233C, Q234C, N235C, P241C, N242C, S244C, G249C, I250C, A251C, G274C, D275C, and V276C, relative to the amino acid sequence of SEQ ID NO: 435. In some embodiments, the soluble polypeptide is a BLys mutein that includes all or a portion of BLys and has one or more (preferably one) of the following pairs of cysteine substitutions: T228C/G274C, T228C/D275C, L229C/G274C, L229C/D275C, F230C/G274C, R231C/G274C, R231C/D275C, R231C/V276C, I233C/N242C, I233C/S244C, Q234C/N242C, N235C/P241C, N235C/N242C, G249C/Y196C, I250C/Q148C, and A251C/Q148C, relative to the amino acid sequence of SEQ ID NO: 435. In yet other embodiments, the polypeptide is a BLys mutein that includes all or a portion of BLys and has at least one cysteine substitution or insertion within one or more, and preferably at least two, of the following amino acid regions: amino acids 134-151, 225-254, and 271-279, relative to the amino acid sequence of SEQ ID NO: 435 (e.g., one cysteine substitution or insertion within two different regions). In some embodiments, each BLys mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 435-466.

In some embodiments, the TNFSF ligand is LIGHT. In some embodiments, the soluble polypeptide is a LIGHT mutein that includes all or a portion of LIGHT and has one, two, three, four, or more of the following cysteine substitutions: H97C, L120C, Y144C, E178C, L179C, L180C, V181C, S182C, Q183C, Q184C, S185C, G188C, T191C, W197C, W198C, S200C, G205C, V206C, V207C, G230C, T231C, and R232C, relative to the amino acid sequence of SEQ ID NO: 467. In some embodiments, the soluble polypeptide is a LIGHT mutein that includes all or a portion of LIGHT and has one or more (preferably one) of the following pairs of cysteine substitutions: E178C/G230C, E178C/T231C, L179C/G230C, L179C/T231C, L180C/G230C, V181C/G230C, V181C/T231C, V181C/R232C, S182C/S200C, Q183C/W198C, Q183C/S200C, Q184C/W198C, S185C/W197C, S185C/W198C, G188C/T191C, G205C/Y144C, V206C/H97C, V207C/H97C, and V207C/L120C, relative to the amino acid sequence of SEQ ID NO: 467. In yet other embodiments, the polypeptide is a LIGHT mutein that includes all or a portion of LIGHT and has at least one cysteine substitution or insertion within one or more, and preferably at least two, of the following amino acid regions: amino acids 83-100, 117-123, 175-210, and 227-235, relative to the amino acid sequence of SEQ ID NO: 467 (e.g., one cysteine substitution or insertion within two different regions). In some embodiments, each LIGHT mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 467-505.

In some embodiments, the TNFSF ligand is TL1. In some embodiments, the soluble polypeptide is a TL1 mutein that includes all or a portion of TL1 and has one, two, three, four, or more of the following cysteine substitutions: H98C, L125C, Y150C, Q193C, L194C, L195C, M196C, G197C, T198C, K199C, S200C, W208C, F209C, P211C, A216C, M217C, F218C, E241C, D242C, and K243C, relative to the amino acid sequence of SEQ ID NO: 506. In some embodiments, the soluble polypeptide is a TL1 mutein that includes all or a portion of TL1 and has one or more (preferably one) of the following pairs cysteine substitutions: Q193C/E241C, Q193C/D242C, L194C/E241C, L194C/D242C, L195C/E241C, M196C/E241C, M196C/D242C, M196C/K243C, G197C/P211C, T198C/F209C, T198C/P211C, K199C/F209C, S200C/W208C, S200C/F209C, A216C/Y150C, M217C/H98C, F218C/H98C, and F218C/L125C, relative to the amino acid sequence of SEQ ID NO: 506. In yet other embodiments, the polypeptide is a TL1 mutein that includes all or a portion of TL1 and has at least one cysteine substitution or insertion within one or more, and preferably at least two, of the following amino acid regions: amino acids 84-101, 122-128, 190-221, and 238-246, relative to the amino acid sequence of SEQ ID NO: 506 (e.g., one cysteine substitution or insertion within two different regions). In some embodiments, each TL1 mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 506-541.

In some embodiments, the TNFSF ligand is GITRL (also known as TL6). In some embodiments, the soluble polypeptide is a GITRL mutein that includes all or a portion of GITRL and has one, two, three, four, or more of the following cysteine substitutions: K83C, Y120C, T148C, L149C, N184C, T1500, N151C, K152C, S153C, I155C, G160C, T161C, and Y162C, relative to the amino acid sequence of SEQ ID NO: 542. In some embodiments, the soluble polypeptide is a GITRL mutein that includes all or a portion of GITRL and has one or more (preferably one) of the following pairs of cysteine substitutions: T148C/N184C, L149C/I155C, T150C/S153C, T150C/I155C, N151C/S153C, K152C/S153C, G160C/Y120C, T161C/K83C, and Y162C/K83C, relative to the amino acid sequence of SEQ ID NO: 542. In yet other embodiments, the polypeptide is a GITRL mutein that includes all or a portion of GITRL and has at least one cysteine substitution or insertion within one or more, and preferably at least two, of the following amino acid regions: amino acids 69-86, 117-123, 145-165, 181-187, and 269-277, relative to the amino acid sequence of SEQ ID NO: 542 (e.g., one cysteine substitution or insertion within two different regions). In some embodiments, each GITRL mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 542-561.

In some embodiments, the TNFSF ligand is CD70. In some embodiments, the soluble polypeptide is a CD70 mutein that includes all or a portion of CD70 and has one, two, three, four, or more of the following cysteine substitutions: R83C, H107C, T127C, L128C, A129C, V130C, G131C, I132C, S134C, S137C, S139C, Q149C, G150C, C151S, T152C, R157C, T159C, T181C, D182C, and E183C, relative to the amino acid sequence of SEQ ID NO: 203. In some embodiments, the soluble polypeptide is a CD70 mutein that includes all or a portion of CD70 and has one or more (preferably one) of the following pairs of cysteine substitutions: T127C/T181C, T127C/D182C, L128C/T181C, L128C/D182C, A129C/T181C, V130C/T181C, V130C/D182C, V130C/E183C, G131C/T152C, I132C/G150C, I132C/T152C, S134C/Q149C, S134C/G150C, S137C/S139C, G150C/C151S, R157C/H107C, and T159C/R83C, relative to the amino acid sequence of SEQ ID NO: 203. In yet other embodiments, the polypeptide is a CD70 mutein that includes all or a portion of CD70 and has at least one cysteine substitution or insertion within one or more, and preferably at least two, of the following amino acid regions: amino acids 69-86, 104-110, 124-162, and 178-186, relative to the amino acid sequence of SEQ ID NO: 203 (e.g., one cysteine substitution or insertion within two different regions). In some embodiments, each CD70 mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 203-235 and 654-656. In some embodiments, a naturally occurring cysteine residue of a CD70 mutein, e.g., residue C151, may be mutated to a serine residue in order to avoid undesired dimerization.

In some embodiments, the TNFSF ligand is EDA (e.g., EDA-A1 and EDA-A2). In some embodiments, the soluble polypeptide is a EDA (e.g., EDA-A1 and EDA-A2) mutein that includes all or a portion of EDA and has one, two, three, four, or more of the following cysteine substitutions: V250C, H252C, T278C, Y304C, P328C, F329C, L330C, Q331C, T333C, R334C, S335C, N342C, Y343C, T345C, G350C, V351C, H376C, and T377C, relative to the amino acid sequence of SEQ ID NO: 562 or 590. In some embodiments, the soluble polypeptide is a EDA (e.g., EDA-A1 and EDA-A2) mutein that includes all or a portion of EDA and has one or more (preferably one) of the following pairs of cysteine substitutions: P328C/H376C 577, F329C/H376C, L330C/H376C, L330C/T377C, Q331C/H376C, Q331C/T377C, T333C/Y343C, T333C/T345C, R334C/Y343C, S335C/N342C, S335C/Y343C, G350C/Y304C, V351C/V250C, and V351C/H252C, relative to the amino acid sequence of SEQ ID NO: 562 or 590. In yet other embodiments, the polypeptide is a EDA (e.g., EDA-A1 and EDA-A2) mutein that includes all or a portion of EDA and has at least one cysteine substitution or insertion within one or more, and preferably at least two, of the following amino acid regions: amino acids 238-255, 275-281, 301-307, 325-354, and 373-380, relative to the amino acid sequence of SEQ ID NO: 562 or 590 (e.g., one cysteine substitution or insertion within two different regions). In some embodiments, each EDA mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 562-619.

In some embodiments, the TNF-like ligand is adiponectin. In some embodiments, the soluble polypeptide is an adiponectin mutein that includes all or a portion of adiponectin and has one, two, three, four, or more of the following cysteine substitutions: S116C, A161C, A181C, M182C, L183C, F184C, T185C, Y186C, D187C, Q188C, N193C, V194C, Q196C, V201C, L202C, D229C, N230C, and D231C, relative to the amino acid sequence of SEQ ID NO: 688. In some embodiments, the soluble polypeptide is an adiponectin mutein that includes all or a portion of adiponectin and has one or more (preferably one) of the following pairs of cysteine substitutions: A181C/D229C, A181C/N230C, M182C/D229C, M182C/N230C, L183C/D229C, F184C/D229C, F184C/N230C, F184C/D231C, T185C/Q196C, Y186C/V194C, Y186C/Q196C, D187C/V194C, Q188C/N193C, Q188C/V194C, V201C/A161C, and L202C/S116C, relative to the amino acid sequence of SEQ ID NO: 688. In yet other embodiments, the polypeptide is an adiponectin mutein that includes all or a portion of adiponectin and has at least one cysteine substitution or insertion within one or more, and preferably at least two, of the following amino acid regions: amino acids 103-119, 158-164, 178-205, and 226-234, relative to the amino acid sequence of SEQ ID NO: 688 (e.g., one cysteine substitution or insertion within two different regions). In some embodiments, each adiponectin mutein or fragment thereof has at least one (and preferably at least two) cysteine substitutions or insertions (as described above) and has at least 50% sequence identity (e.g., 50%, 55%, 60%, 65%, 70%, 75%, 80%, 85%, 90%, 95%, 99%, or 100%) to a sequence selected from any one of SEQ ID NOs: 688-722.

In some embodiments, the soluble polypeptides of the first aspect of the invention have at least one (and preferably at least two) cysteine substitutions or insertions (as described above) and have at least 50% (e.g., at least 60%, 70%, 75%, 80%, 85%, 90%, 92%, 95%, 97%, 99%, or 100%) sequence identity to any one of SEQ ID NOs: 1-735, or a biologically active fragment thereof. In other embodiments, these soluble polypeptides (muteins) lack the transmembrane domain and, optionally, also the cytoplasmic domain of the TNFSF or TNF-like ligand. Preferably, both the transmembrane and cytoplasmic domains are absent.

In a preferred embodiment, the soluble polypeptides of the first aspect of the invention have at least one (and preferably at least two) cysteine substitutions or insertions (as described above) and has at least 50% (e.g., at least 60%, 70%, 75%, 80%, 85%, 90%, 92%, 95%, 97%, 99%, or 100%) sequence identity to the sequence of SEQ ID NO: 1, or a biologically active fragment thereof, and lack the transmembrane domain and, optionally, also the cytoplasmic domain of TNF-α. Preferably, both the transmembrane and cytoplasmic domains are absent.

In some embodiments, the soluble polypeptides of the first aspect of the invention is or is capable of forming a homo-multimer, particularly a homo-dimer or homo-trimer, more particularly a homo-trimer. Preferably, the TNF-α mutein containing the S171C/G224 substitutions can form a disulfide bonded, homo-trimer complex.

In an embodiment, the surface-exposed, exterior-facing amino acid residue that is substituted with a cysteine residue in the soluble polypeptides of the first aspect of the invention is a naturally-occurring amino acid residue of the TNFSF or TNF-like ligand. For example, if the TNFSF or TNF-like ligand is a fusion protein that includes a second polypeptide that is not endogenous to the TNFSF or TNF-like ligand, the substitution occurs at a naturally-occurring amino acid residue of the TNFSF or TNF-like ligand and not at an amino acid residue of the second polypeptide.

In a second aspect, the invention features a nucleic acid molecule encoding the polypeptides of the first aspect of the invention (e.g., a TNFSF or TNF-like ligand mutein having at least one surface-exposed, exterior-facing amino acid residue that has been substituted with a cysteine residue, relative to a naturally occurring TNFSF or TNF-like ligand). In other embodiments, the nucleic acid molecule encodes a TNFSF or TNF-like ligand mutein having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to any one of SEQ ID NOs: 1-735, or a biologically active fragment thereof, in which at least one surface-exposed, exterior-facing amino acid residue of the TNFSF or TNF-like ligand mutein encoded by the nucleic acid molecule is a cysteine residue that is not present in a naturally occurring TNFSF or TNF-like ligand. In some embodiments, at least two surface-exposed, exterior-facing amino acid residues of the TNFSF or TNF-like ligand mutein encoded by the nucleic acid molecule are cysteine residues that are not present in a naturally occurring TNFSF or TNF-like ligand. In other embodiments, at least three or four surface-exposed, exterior-facing amino acid residues of the TNFSF or TNF-like ligand mutein encoded by the nucleic acid molecule are cysteine residues that are not present in a naturally occurring TNFSF or TNF-like ligand. In still other embodiments, the nucleic acid molecule encodes a soluble TNFSF or TNF-like ligand mutein that lacks a transmembrane domain and, optionally, also the cytoplasmic domain of the TNFSF or TNF-like ligand. Preferably, the nucleic acid molecule encodes a soluble TNFSF or TNF-like ligand mutein lacking the transmembrane and cytoplasmic domains of the TNFSF or TNF-like ligand. In an embodiment, the nucleic acid molecule encodes a TNF-α mutein containing S171C and G224C substitutions; preferably the TNF-α mutein lacks the transmembrane and cytoplasmic domains of TNF-α.

In some embodiments, the nucleic acid molecule is in a vector, a cell (e.g., a human or non-human cell; the cell may be in vivo or ex vivo), or an animal (e.g., a human or a non-human animal). In some embodiments, the vector is an adenovirus vector (e.g., Ad5, Ad26, Ad34, Ad35), poxvirus vector, vaccinia virus vector (e.g., Modified Vaccinia Virus Ankara (MVA)), retrovirus vector, adeno-associated virus vector, or alphavirus vector.

In a third aspect, the invention features a pharmaceutical composition including a therapeutically effective amount of a polypeptide of the first aspect of the invention (e.g., a soluble polypeptide of the first aspect of the invention lacking one or both of the transmembrane and cytoplasmic domains of the TNFSF or TNF-like ligand).

In a fourth aspect, the invention features a pharmaceutical composition including a nucleic acid molecule of the second aspect of the invention that encodes a polypeptide of the first aspect of the invention (e.g., a soluble polypeptide of the first aspect of the invention lacking one or both of the transmembrane and cytoplasmic domains of the TNFSF or TNF-like ligand).

Preferably, in the third and fourth aspects of the invention, the soluble polypeptide includes all or a portion of TNF-α in which the soluble polypeptide contains one or more (e.g., one, two, three, or four) of the following cysteine substitutions: R82C, T83C, P84C, S85C, H91C, N110C, G130C, L131C, Y135C, N168C, L169C, L170C, S171C, A172C, I173C, K174C, S175C, Q178C, E180C, W190C, Y191C, P193C, G198C, V199C, F200C, Q201C, S223C, G224C, and Q225C, relative to the amino acid sequence of SEQ ID NO: 1 or an amino acid sequence having at least one (and preferably at least two) cysteine substitutions or insertions (as described above) and having at least 50-99% sequence identity to SEQ ID NO: 1, or one or more (preferably one) of the following pairs of cysteine substitutions: G130C/S85C, L131C/T83C, L131C/P84C, S171C/G224C, N168C/S223C, N168C/G224C, L169C/S223C, L169C/G224C, L170C/S223C, S171C/S223C, S171C/Q225C, A172C/P193C, I173C/Y191C, I173C/P193C, K174C/Y191C, S175C/W190C, S175C/Y191C, Q178C/E180C, G198C/Y135C, V199C/H91C, F200C/H91C, F200C/N110C, Q201C/R82C, and Q201C/T83C, relative to the amino acid sequence of SEQ ID NO: 1 or an amino acid sequence having at least one (and preferably at least two) cysteine substitutions or insertions (as described above) and having at least 50-99% sequence identity to SEQ ID NO: 1. In an embodiment, the soluble polypeptide contains S171C and/or G224C relative to the amino acid sequence of SEQ ID NO: 1 or an amino acid sequence having at least 50-99% sequence identity to SEQ ID NO: 1.

The pharmaceutical composition may include one or more pharmaceutically acceptable carriers or excipients.

In a fifth aspect, the invention features a method of medical therapy including administering a polypeptide of the first aspect of the invention (e.g., a soluble polypeptide), a nucleic acid molecule of the second aspect of the invention (e.g., a nucleic acid molecule encoding a soluble polypeptide), or a pharmaceutical composition of the third or fourth aspect of the invention, to a subject in need thereof. In an embodiment, the subject is in need of treatment for an autoimmune disease, a neurological disease, a cancer, an infectious disease, a metabolic disease (e.g., diabetes), a macular disease (e.g., macular degeneration), muscular atrophy, a disease related to miscarriage, a vascular disease (e.g., atherosclerosis), a disease related to bone loss (i.e., bone loss as a result of menopause, osteoporosis), an allergy, a blood disorder (e.g., hemophilia), acquired immunodeficiency syndrome (AIDS), a musculoskeletal disorder, a disease related to growth receptors, or obesity, is in need of tissue or organ repair or regeneration, or is in need of treatment in conjunction with an organ transplantation (e.g., to treat or reduce complications resulting from organ transplantation (e.g., graft-versus-host disease (GVHD) and graft rejection)). In other embodiments, the subject is administered a TNFSF or TNF-like ligand mutein of the first aspect of the invention selected from the group consisting of a TNF-α mutein, lymphotoxin mutein (e.g., LT-α mutein and LT-β mutein), CD40L mutein, CD70 mutein, CD153 mutein, OX40L mutein, FasL mutein, 4-1BB ligand mutein, TRAIL mutein, RANKL mutein, TWEAK mutein, APRIL mutein, BLys mutein, LIGHT mutein, TL1 mutein, GITRL (also known as TL6) mutein, EDA mutein (e.g., EDA-A1 mutein and EDA-A2 mutein), and adiponectin mutein or a nucleic acid molecule of the second aspect of the invention that encodes the TNFSF or TNF-like ligand mutein. In an embodiment, the subject is administered a TNF-α mutein or a TRAIL mutein. In still other embodiments, the polypeptide is a soluble polypeptide lacking one or both of the transmembrane and cytoplasmic domains of the TNFSF or TNF-like ligand (preferably both the transmembrane and cytoplasmic domains are absent). In other embodiments, the TNFSF or TNF-like ligand mutein administered to the subject has at least one (and preferably at least two) cysteine substitutions or insertions (as described above) and has at least 50% (e.g., at least 60%, 70%, 75%, 80%, 85%, 90%, 92%, 95%, 97%, 99%, or 100%, preferably 100%) sequence identity to any one of SEQ ID NOs: 1-735, or a biologically active fragment thereof, and includes at least one substitution or insertion (e.g., two, three, or four substitutions or insertions; preferably two substitutions or insertions) of a surface-exposed, exterior-facing amino acid residue of the TNFSF or TNF-like ligand with a cysteine residue.

In some embodiments, the subject has an autoimmune disease (e.g., an autoimmune disease selected from the group consisting of insulin dependent diabetes, Alopecia Areata, Ankylosing Spondylitis, Antiphospholipid Syndrome, Addison's Disease, Hemolytic Anemia, Autoimmune Hepatitis, Behcets Disease, Bullous Pemphigoid, Cardiomyopathy, Celiac Sprue-Dermatitis, Chronic Fatigue Immune Dysfunction Syndrome (CFIDS), Chronic Inflammatory Demyelinating Polyneuropathy, Churg-Strauss Syndrome, Cicatricial Pemphigoid, Limited Scleroderma (CREST Syndrome), Cold Agglutinin Disease, Crohn's Disease, Discoid Lupus, Essential Mixed Cryoglobulinemia, Fibromyalgia-Fibromyositis, Graves' Disease, Guillain- Barré Syndrome, Hashimoto's Thyroiditis, Hypothyroidism, Inflammatory Bowel Disease, autoimmune lymphoproliferative syndrome (ALPS), Idiopathic Pulmonary Fibrosis, Idiopathic Thrombocytopenia Purpura (ITP), IgA Nephropathy, Juvenile Arthritis, Lichen Planus, Lupus, Meniere's Disease, Mixed Connective Tissue Disease, Multiple Sclerosis, Myasthenia Gravis, Pemphigus Vulgaris, Pernicious Anemia, Polyarteritis Nodosa, Polychondritis, Polyglandular Syndromes, Polymyalgia Rheumatica, Polymyositis, Dermatomyositis, Primary Agammaglobulinemia, Primary Biliary Cirrhosis, Psoriasis, Raynaud's Phenomenon, Reiter's Syndrome, Rheumatic Fever, Rheumatoid Arthritis, Sarcoidosis, Scleroderma, Sjögren's Syndrome, Stiff-Man Syndrome, Takayasu Arteritis, Temporal Arteritis/Giant Cell Arteritis, Ulcerative Colitis, Uveitis, Vasculitis, Vitiligo, and Wegener's Granulomatosis). Preferably the autoimmune disease is insulin dependent diabetes, rheumatoid arthritis, Sjögren's syndrome, multiple sclerosis, or Crohn's disease. In particular, the autoimmune disease is insulin dependent diabetes. In an embodiment, the subject being treated for an autoimmune disease is administered a TNF-α mutein (e.g., a soluble TNF-α mutein having the S171C/G224C substitutions). Preferably when the autoimmune disease is insulin dependent diabetes, rheumatoid arthritis, Sjögren's syndrome, multiple sclerosis, or Crohn's disease, the subject is administered a TNF-α mutein of the invention (e.g., a TNF-α mutein of the first aspect, or a nucleic acid molecule of the second aspect encoding a TNF-α mutein, or a pharmaceutical composition of the third or fourth aspect). In particular, the TNF-α mutein is a soluble polypeptide that lacks one or both of the transmembrane and cytoplasmic domains; preferably, both the transmembrane and cytoplasmic domains are absent. In other embodiments, the TNF-α mutein has the S171C/G224C substitutions and is a soluble polypeptide (e.g., lacks one or both of the transmembrane and cytoplasmic domains; preferably, both the transmembrane and cytoplasmic domains are absent). In an embodiment, the TNF-α mutein has the S171C/G224C substitutions and is a soluble polypeptide (e.g., lacks one or both of the transmembrane and cytoplasmic domains; preferably, both the transmembrane and cytoplasmic domains are absent) and the disease to be treated is insulin dependent diabetes, rheumatoid arthritis, Sjögren's syndrome, multiple sclerosis, or Crohn's disease (in particular, the disease is insulin dependent diabetes).

In some embodiments, the subject is in need of tissue or organ repair or regeneration. In some embodiments, the tissue or organ is pancreas, salivary gland, pituitary gland, kidney, heart, lung, hematopoietic system, cranial nerves, heart, blood vessels including the aorta, olfactory gland, ear, nerves, structures of the head, eye, thymus, tongue, bone, liver, small intestine, large intestine, gut, lung, brain, skin, peripheral nervous system, central nervous system, spinal cord, breast, embryonic structures, embryos, or testes. In other embodiments, the subject is in need of cell transplantation. In some embodiments, cells used in cell transplantation may be cells isolated from the organs of a mammal (e.g., a human), such as insulin-secreting cells from the islets of Langerhans, neurons, fibroblasts, stem cells (e.g., bone marrow stem cells), myocytes, myoblasts, and cardiac cells. In several embodiments, the subject is administered a TNFSF or TNF-like ligand mutein of the first aspect of the invention selected from the group consisting of a TNF-α mutein, lymphotoxin mutein (e.g., LT-α mutein and LT-β mutein), CD40L mutein, CD70 mutein, CD153 mutein, OX40L mutein, FasL mutein, 4-1BB ligand mutein, TRAIL mutein, RANKL mutein, TWEAK mutein, APRIL mutein, BLys mutein, LIGHT mutein, TL1 mutein, GITRL (also known as TL6) mutein, EDA mutein (e.g., EDA-A1 mutein and EDA-A2 mutein), and adiponectin mutein or a nucleic acid molecule of the second aspect of the invention that encodes the TNFSF or TNF-like ligand mutein. Preferably, the subject is administered a TNF-α mutein of the invention (e.g., a TNF-α mutein of the first aspect, or a nucleic acid molecule of the second aspect encoding a TNF-α mutein, or a pharmaceutical composition of the third or fourth aspect). In particular, the TNF-α mutein is a soluble polypeptide that lacks one or both of the transmembrane and cytoplasmic domains; preferably, both the transmembrane and cytoplasmic domains are absent. In other embodiments, the TNF-α mutein has the S171C/G224C substitutions and is a soluble polypeptide (e.g., lacks one or both of the transmembrane and cytoplasmic domains; preferably, both the transmembrane and cytoplasmic domains are absent).

In some embodiments, the subject has cancer. In some embodiments, the cancer may be solid tumor cancer or hematopoietic cancer. In some embodiments, the cancer is selected from bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, oligoastrocytoma, bone cancer, brain cancer, gastrointestinal cancer, cardiac cancer, uterine cancer, head and neck cancer, gallbladder cancer, laryngeal cancer, lip and oral cavity cancer, ocular cancer, colorectal cancer, testicular cancer, throat cancer, acute lymphoblastic leukemia (ALL), chronic myelogenous leukemia (CML), adrenocortical carcinoma, AIDS-related lymphoma, primary CNS lymphoma, anal cancer, appendix cancer, atypical teratoid/rhabdoid tumor, basal cell carcinoma, bile duct cancer, extrahepatic cancer, ewing sarcoma family, osteosarcoma and malignant fibrous histiocytoma, central nervous system embryonal tumors, central nervous system germ cell tumors, craniopharyngioma, ependymoma, bronchial tumors, burkitt lymphoma, carcinoid tumor, primary lymphoma, chordoma, chronic myeloproliferative neoplasms, extrahepatic ductal carcinoma in situ (DCIS), endometrial cancer, esophageal cancer, esthesioneuroblastoma, extracranial germ cell tumor, extragonadal germ cell tumor, fallopian tube cancer, fibrous histiocytoma of bone, gastrointestinal carcinoid tumor, gastrointestinal stromal tumors (GIST), testicular germ cell tumor, gestational trophoblastic disease, glioma, childhood brain stem glioma, hairy cell leukemia, hepatocellular cancer, langerhans cell histiocytosis, hodgkin lymphoma, hypopharyngeal cancer, islet cell tumors, pancreatic neuroendocrine tumors, wilms tumor and other childhood kidney tumors, langerhans cell histiocytosis, small cell lung cancer, cutaneous T-cell lymphoma, intraocular melanoma, merkel cell carcinoma, mesothelioma, metastatic squamous neck cancer, midline tract carcinoma, multiple endocrine neoplasia syndromes, myelodysplastic syndromes, nasal cavity and paranasal sinus cancer, nasopharyngeal cancer, epithelial ovarian cancer, germ cell ovarian cancer, low malignant potential ovarian cancer, papillomatosis, paraganglioma, parathyroid cancer, penile cancer, pharyngeal cancer, pheochromocytoma, pituitary tumor, pleuropulmonary blastoma, primary peritoneal cancer, rectal cancer, retinoblastoma, rhabdomyosarcoma, salivary gland cancer, kaposi sarcoma, sézary syndrome, small intestine cancer, thymoma and thymic carcinoma, thyroid cancer, transitional cell cancer of the renal pelvis and ureter, urethral cancer, endometrial uterine cancer, uterine sarcoma, vaginal cancer, vulvar cancer, and waldenström macroglobulinemia. Preferably, the subject is administered a TNF-α mutein of the invention (e.g., a TNF-α mutein of the first aspect, or a nucleic acid molecule of the second aspect encoding a TNF-α mutein, or a pharmaceutical composition of the third or fourth aspect) to treat the cancer. In particular, the TNF-α mutein is a soluble polypeptide that lacks one or both of the transmembrane and cytoplasmic domains; preferably, both the transmembrane and cytoplasmic domains are absent. In other embodiments, the subject is administered a TRAIL mutein of the invention (e.g., the first, second, third, and fourth aspects of the invention) to treat the cancer. The method may further include administering one or more chemotherapy agents, immunotherapy agents, or radiation to the subject.

In some embodiments, the chemotherapy agent is selected from the group consisting of camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus.

In some embodiments, the immunotherapy agent is selected from the group consisting of an anti-TNF receptor superfamily agonist antibody, an anti-TNF receptor superfamily antagonist antibody, an anti-CTLA-4 agent, an anti-PD-1 agent, an anti-PD-L1 agent, an anti-PD-L2 agent, a TNF-α cross-linking agent, a TRAIL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al., Cancer Immunotherapy 14:561-584, 2015, which is incorporated herein by reference in its entirety. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1A may be targeted with an anti-TL1A antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some embodiments, the subject has a neurological disease. In some embodiments, the neurological disease is selected from a brain tumor, a brain metastasis, schizophrenia, epilepsy, Amyotrophic lateral sclerosis (ALS), Parkinson's disease, Alzheimer's disease, Huntington's disease, and stroke. Preferably, the neurological disease is Amyotrophic lateral sclerosis (ALS), Parkinson's disease, or Alzheimer's disease. In several embodiments, the subject is administered a TNFSF or TNF-like ligand mutein of the first aspect of the invention selected from the group consisting of a TNF-α mutein, lymphotoxin mutein (e.g., LT-α mutein and LT-β mutein), CD40L mutein, CD70 mutein, CD153 mutein, OX40L mutein, FasL mutein, 4-1BB ligand mutein, TRAIL mutein, RANKL mutein, TWEAK mutein, APRIL mutein, BLys mutein, LIGHT mutein, TL1 mutein, GITRL (also known as TL6) mutein, EDA mutein (e.g., EDA-A1 mutein and EDA-A2 mutein), and adiponectin mutein or a nucleic acid molecule of the second aspect of the invention that encodes the TNFSF or TNF-like ligand mutein. Preferably, the subject is administered a TNF-α mutein of the invention (e.g., a TNF-α mutein of the first aspect, or a nucleic acid molecule of the second aspect encoding a TNF-α mutein, or a pharmaceutical composition of the third or fourth aspect). In particular, the TNF-α mutein is a soluble polypeptide that lacks one or both of the transmembrane and cytoplasmic domains; preferably, both the transmembrane and cytoplasmic domains are absent. In other embodiments, the TNF-α mutein has the S171C/G224C substitutions and is a soluble polypeptide (e.g., lacks one or both of the transmembrane and cytoplasmic domains; preferably, both the transmembrane and cytoplasmic domains are absent). In an embodiment, the TNF-α mutein has the S171C/G224C substitutions and is a soluble polypeptide (e.g., lacks one or both of the transmembrane and cytoplasmic domains; preferably, both the transmembrane and cytoplasmic domains are absent) and the disease is Amyotrophic lateral sclerosis (ALS), Parkinson's disease, or Alzheimer's disease.

In some embodiments, the method includes administering a pharmaceutical composition including a therapeutically effective amount of the polypeptide that includes all or a portion of TNF-α. In particular, the polypeptide is a TNF-α mutein that includes all or a portion of TNF-α having one or more (e.g., one, two, three, or four) of the following cysteine substitutions: R82C, T83C, P84C, S85C, H91C, N110C, G130C, L131C, Y135C, N168C, L169C, L170C, S171C, A172C, I173C, K174C, S175C, Q178C, E180C, W190C, Y191C, P193C, G198C, V199C, F200C, Q201C, S223C, G224C, and Q225C, relative to the amino acid sequence of SEQ ID NO: 1 (or an amino acid sequence having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to SEQ ID NO: 1. In an embodiment, the TNF-α mutein is a soluble polypeptide that lacks a transmembrane domain and, optionally, also a cytoplasmic domain; preferably, both the transmembrane and cytoplasmic domains are absent.

In other embodiments, the polypeptide is a TNF-α mutein that includes all or a portion of TNF-α having one or more (preferably one) of the following pairs of cysteine substitutions: G130C/S85C, L131C/T83C, L131C/P84C, S171C/G224C, N168C/S223C, N168C/G224C, L169C/S223C, L169C/G224C, L170C/S223C, S171C/S223C, S171C/Q225C, A172C/P193C, I173C/Y191C, I173C/P193C, K174C/Y191C, S175C/W190C, S175C/Y191C, Q178C/E180C, G198C/Y135C, V199C/H91C, F200C/H91C, F200C/N110C, Q201C/R82C, and Q201C/T83C, relative to the amino acid sequence of SEQ ID NO: 1 (or an amino acid sequence having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to SEQ ID NO: 1). In particular, the TNF-α mutein is a soluble polypeptide that lacks one or both of the transmembrane and cytoplasmic domains; preferably, both the transmembrane and cytoplasmic domains are absent.

In some embodiments, the method includes administration of a pharmaceutical composition including a nucleic acid molecule encoding a TNF-α mutein that includes all or a portion of TNF-α having one or more (e.g., one, two, three, or four) of the following cysteine substitutions: R82C, T83C, P84C, S85C, H91C, N110C, G130C, L131C, Y135C, N168C, L169C, L170C, S171C, A172C, I173C, K174C, S175C, Q178C, E180C, W190C, Y191C, P193C, G198C, V199C, F200C, Q201C, S223C, G224C, and Q225C, relative to the amino acid sequence of SEQ ID NO: 1 (or an amino acid sequence having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to SEQ ID NO: 1. In particular, the TNF-α mutein encoded by the nucleic acid molecule is a soluble polypeptide that lacks one or both of the transmembrane and cytoplasmic domains; preferably, both the transmembrane and cytoplasmic domains are absent.

In other embodiments, the nucleic acid molecule encodes a TNF-α mutein that includes all or a portion of TNF-α having one or more (preferably one) of the following pairs of cysteine substitutions: G130C/S85C, L131C/T83C, L131C/P84C, S171C/G224C, N168C/S223C, N168C/G224C, L169C/S223C, L169C/G224C, L170C/S223C, S171C/S223C, S171C/Q225C, A172C/P193C, I173C/Y191C, I173C/P193C, K174C/Y191C, S175C/W190C, S175C/Y191C, Q178C/E180C, G198C/Y135C, V199C/H91C, F200C/H91C, F200C/N110C, Q201C/R82C, and Q201C/T83C, relative to the amino acid sequence of SEQ ID NO: 1 (or an amino acid sequence having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to SEQ ID NO: 1. In particular, the TNF-α mutein is a soluble polypeptide that lacks one or both of the transmembrane and cytoplasmic domains; preferably, both the transmembrane and cytoplasmic domains are absent.

In an embodiment, the nucleic acid molecule encodes a TNF-α mutein that includes all or a portion of TNF-α having the S171C/G224C substitutions. In particular, the TNF-α mutein encoded by the nucleic acid molecule is a soluble polypeptide that lacks one or both of the transmembrane and cytoplasmic domains; preferably, both the transmembrane and cytoplasmic domains are absent.

The method may further include administering one or more immunotherapy agents in combination with a pharmaceutical composition including a therapeutically effective amount of a TNF-α mutein described herein in a cancer immunotherapy. In some embodiments, the immunotherapy agent in the cancer immunotherapy is selected from the group consisting of an anti-TNF receptor superfamily agonist antibody, an anti-TNF receptor superfamily antagonist antibody, an anti-CTLA-4 agent, an anti-PD-1 agent, an anti-PD-L1 agent, an anti-PD-L2 agent, a TNF-α cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al.

For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1A may be targeted with an anti-TL1A antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In a sixth aspect, the invention features a method of preparing any one of the polypeptides of the first aspect of the invention (e.g., a soluble polypeptide of the first aspect that lacks one or both of the transmembrane and cytoplasmic domains of the TNFSF or TNF-like ligand). The method includes: a) providing a host cell that contains a polynucleotide encoding the polypeptide, b) expressing the polypeptide in the host cell, and, optionally, c) recovering the polypeptide. In an embodiment, the host cell is prepared by incorporating the nucleic acid molecule into the host cell (e.g., by transformation, transfection, electroporation, calcium phosphate precipitation, direct microinjection, infection, etc). In another embodiment, the host cell is in a mammal, e.g., a human. The method may be performed in the context of a method of treatment (e.g., treatment of one or more of the diseases or disorders of the fifth aspect of the invention), in which case recovery step c) is not performed. The nucleic acid molecule can be incorporated by contacting the host cell with a vector (e.g., an adenovirus vector (e.g., Ad5, Ad26, Ad34, Ad35), poxvirus vector, vaccinia virus vector (e.g., Modified Vaccinia Virus Ankara (MVA)), retrovirus vector, adeno-associated virus vector, or alphavirus vector) that contains the nucleic acid molecule. Preferably, the polypeptide is expressed in the form of a multimer, e.g., a trimer. In other embodiments, recovery step c) of the method includes eliminating polypeptides that are not in the form of a multimer (e.g., a trimer). In still other embodiments, the polypeptide is a soluble polypeptide having at least one (and preferably at least two) cysteine substitutions or insertions (as described above) and having at least 50% (e.g., at least 60%, 70%, 75%, 80%, 85%, 90%, 92%, 95%, 97%, 99%, or 100%) sequence identity to any one of SEQ ID NOs: 1-735, or a biologically active fragment thereof, and that lacks the sequence of the transmembrane domain and, optionally, also the cytoplasmic domain; preferably, both the transmembrane and cytoplasmic domains are absent. In still other embodiments, the soluble polypeptide has at least one (and preferably at least two) cysteine substitutions or insertions (as described above) and has at least 50% (e.g., at least 60%, 70%, 75%, 80%, 85%, 90%, 92%, 95%, 97%, 99%, or 100%) sequence identity to the sequence of SEQ ID NO: 1, or a biologically active fragment thereof, and lacks the sequence of the transmembrane domain and, optionally, also the cytoplasmic domain; preferably, both the transmembrane and cytoplasmic domains are absent. In an embodiment, the soluble polypeptide is a TNF-α mutein that has the S171C/G224C substitutions.

In a seventh aspect, the invention features a host cell that expresses a polypeptide of the first aspect of the invention (e.g., a soluble polypeptide of the first aspect that lacks one or both of the transmembrane and cytoplasmic domains of the TNFSF or TNF-like ligand). In particular, the host cell includes an exogenous nucleic acid molecule encoding the polypeptide (e.g., a nucleic acid molecule of the second aspect of the invention) in which the nucleic acid molecule is expressed in the host cell. In some embodiments, the nucleic acid molecule is in a vector. In other embodiments, the host cell is a human or non-human cell. In still other embodiments, the host cell is in an animal (e.g., a human or a non-human animal). In some embodiments, the vector is an adenovirus vector (e.g., Ad5, Ad26, Ad34, Ad35), poxvirus vector, vaccinia virus vector (e.g., Modified Vaccinia Virus Ankara (MVA)), retrovirus vector, adeno-associated virus vector, or alphavirus vector.

Definitions

As used herein, the term "soluble polypeptide" refers to an extracellular portion of a TNFSF or TNF-like ligand. The soluble polypeptide of the invention lacks the transmembrane domain of the TNFSF or TNF-like ligand and, optionally, also the cytoplasmic domain. Preferably, a soluble polypeptide lacks both the transmembrane and cytoplasmic domains. The soluble polypeptide contains at least one amino acid substitution of a surface-exposed (e.g., an exterior facing) amino acid residue of the TNFSF or TNF-like ligand with a cysteine residue.

As used herein, the term "surface-exposed" is used to describe the location or position of an amino acid in a TNFSF or TNF-like ligand. A surface-exposed amino acid is located in the extracellular domain of the TNFSF or TNF-like ligand (e.g., the domain of the TNFSF or TNF-like ligand is naturally present on the outside of the cell). Preferably, the amino acid is "exterior-facing," such that the amino acid is spatially located on the outside surface of the protein when it is folded into a tertiary structure. The exterior facing amino acid is preferably accessible for interaction (e.g., covalent bonding, such as disulfide bonding) with an amino acid (e.g., a surface-exposed amino acid) on a second TNFSF or TNF-like ligand (e.g., a TNFSF or TNF-like ligand mutein of the invention), such that the two proteins can produce a quaternary structure having at least two or more (e.g., at least three) interacting (e.g., disulfide bonded) monomers.

As used herein, the term "mutein," "TNFSF ligand mutein," or "TNF-like ligand mutein" refers to a TNFSF or TNF-like ligand having at least one amino acid substitution (e.g., two, three, four, five, or six amino acid substitutions; in particular two amino acid substitutions) that replace the wild-type residue(s) (a non-cysteine residue) with a cysteine residue or at least one cysteine insertion (e.g., two, three, four, five, or six cysteine insertions; in particular two cysteine insertions). The mutein can be covalently bonded (e.g., disulfide bonded) to other TNFSF or TNF-like ligands, such as TNFSF or TNF-like ligand muteins of the invention, to produce multimeric forms, including forms having at least two (e.g., two, three, four, five, six, seven, eight, nine, or ten) covalently bonded TNFSF or TNF-like ligand monomers. Preferably, a covalently bonded (e.g., disulfide bonded) mutein contains three TNFSF or TNF-like ligand monomers. Each TNFSF or TNF-like ligand monomer contains at least one cysteine residue substitution or insertion (in particular two cysteine residue substitutions or insertions), which forms a disulfide bond with another cysteine residue on a neighboring TNFSF or TNF-like ligand monomer. For example, a TNFSF mutein having two cysteine substitutions or insertions can form a trimer in which a first cysteine residue on a first TNFSF ligand mutein can form a disulfide bond with a first cysteine residue on a second TNFSF mutein (e.g., at a different amino acid position relative to the cysteine residue of the first TNFSF ligand mutein) and a second cysteine residue on the first TNFSF ligand mutein can form a disulfide bond with a first cysteine residue on a third TNFSF mutein (e.g., at a different amino acid position relative to the second cysteine residue of the first TNFSF ligand mutein). A second cysteine residue on the second TNFSF mutein can form a disulfide bond with a second cysteine residue on the third TNFSF mutein to complete the trimer.

As used herein, the term "TNF homology domain" refers to the C-terminal extracellular domain, which is the common structural motif shared by TNFSF and TNF-like ligands. The TNF homology domain has 20-30% amino acid identity between TNFSF ligands and is responsible for binding to the receptor (Bharat, Nature Reviews Immunology 3:745-756, 2003).

As used herein, the term "TNFSF ligand" refers to structurally related ligands of the tumor necrosis factor superfamily (TNFSF). Each TNFSF ligand travels as a preferential complex in the body to bind to its respective receptors to exert its biological activity. TNFSF ligands display diverse functions in cell proliferation, inflammation, apoptosis, morphogenesis, lymphoid development, and T and B cell responses. Most TNFSF ligands are synthesized as a type II transmembrane protein (extracellular C-terminus) and exist in the form of a homotrimer within the membrane. These transmembrane ligands are usually released from the outer cell membrane by proteolytic cleavage to form soluble TNFSF ligands. Soluble TNFSF ligands are not very active as monomers and therefore must multimerize to form multimers (e.g., a homotrimer) to bind to their receptors. Soluble TNFSF ligands may circulate in the body as monomers, but optimally form multimers (e.g., a homotrimer) upon receptor binding, thus causing the receptors to multimerize, as well.

As used herein, the term "TNF-like ligand" refers to ligands that have similar folding topologies, key amino acid residue conservations, trimer interfaces, and intron positions as those of the TNFSF ligands. TNF-like ligands include complement-1q (C1q) family of proteins (also known as TNF-related family of proteins), e.g., adiponectin, myonectin, complement-1q tumor necrosis factor-related protein 3 (C1QTNF3), and C1QTNF5.

As used herein, the term "conservative substitution" refers to the replacement of an amino acid for another amino acid within a family of amino acids that are related by the similar chemical nature of their side chains. Genetically encoded amino acids can be divided into four families: acidic (aspartate, glutamate); basic (lysine, arginine, histidine); nonpolar (alanine, valine, leucine, isoleucine, proline, phenylalanine, methionine, tryptophan); and uncharged polar (glycine, asparagine, glutamine, cysteine, serine, threonine, tyrosine). Phenylalanine, tryptophan, and tyrosine are sometimes grouped as aromatic amino acids. In similar fashion, the amino acids can also be separated into the following groups: acidic (aspartate, glutamate); basic (lysine, arginine, histidine); aliphatic (glycine, alanine, valine, leucine, isoleucine, serine, threonine), with serine and threonine optionally grouped separately as aliphatic-hydroxyl; aromatic (phenylalanine, tyrosine, tryptophan); amide (asparagine, glutamine); and sulfur-containing (cysteine, methionine).

As used herein, the term "specifically binds" refers to the preferential association of a binding moiety (e.g., a TNFSF or TNF-like ligand mutein, such as a TNF-α mutein) to a target molecule (e.g., a TNFSF receptor, such as TNFR2) in the presence of other molecules in a sample (e.g., a biological sample) or in vivo or ex vivo. It is recognized that a certain degree of non-specific interaction may occur between a binding moiety and a non-target molecule. Nevertheless, specific binding may be distinguished as mediated through specific recognition of the target molecule. Specific binding results in a stronger association between the binding moiety (e.g., a TNFSF or TNF-like ligand mutein, such as a TNF-α mutein) and a target molecule (e.g., a TNFSF receptor, such as TNFR2) than between the binding moiety and a non-target molecule. For example, a TNFSF mutein may specifically bind to a TNFSF receptor (a target molecule) over other receptors (e.g., a non-TNFSF receptor (a non-target molecule)). The TNFSF mutein may have, e.g., at least 2-fold greater affinity (e.g., 2, 3, 4, 5, 6, 7, 8, 9, 10, $10^2$-, $10^3$-, $10^4$-, $10^5$-, $10^6$-, $10^7$-, $10^8$-, $10^9$-, or $10^{10}$-fold greater affinity) to TNFSF receptor than to a non-TNFSF receptor. In a specific example, a TNF-α mutein may specifically bind to TNFR2 (a target molecule) over TNFR1 (a non-target molecule). The TNF-α mutein may have, e.g., at least 2-fold greater affinity (e.g., 2, 3, 4, 5, 6, 7, 8, 9, 10, $10^2$-, $10^3$-, $10^4$-, $10^5$-, $10^6$-, $10^7$-, $10^8$-, $10^9$-, or $10^{10}$-fold greater affinity) for TNFR2 than for TNFR1 or other TNFSF receptors.

As used herein, the term "agonist" refers to a biologically active ligand, e.g., a protein, a nucleic acid, a lipid, a carbohydrate, that interacts with a cell receptor to produce a biological response, e.g., a stimulatory signal, in a cell. Preferably, agonists refer to TNFSF and TNF-like ligand muteins that act to stimulate cells (e.g., immune cells) by preferentially interacting with specific receptors of TNFSF and TNF-like ligands on the cells (e.g., immune cells).

As used herein, the term "antagonist" refers to a biologically active ligand, e.g., a protein, a nucleic acid, a lipid, a carbohydrate, that interacts with a cell receptor to inhibit or reduce a biological response in a cell. Preferably, antagonists refer to TNFSF and TNF-like ligand muteins that act to inhibit or reduce the activity of cells (e.g., immune cells and cancer cells) by interacting with specific receptors of TNFSF and TNF-like ligands on the cells.

As used herein, the term "TNFR2-specific agonist" refers to a biologically active ligand, e.g., a protein, a nucleic acid, a lipid, a carbohydrate, that interacts with the TNFR2 receptor to produce a biological response, e.g., a stimulatory signal, in a cell. Preferably, a TNFR2-specific agonist is a TNF-α mutein that acts to stimulate cells (e.g., immune cells) by preferentially interacting with TNFR2 receptors on the cells (e.g., immune cells). For example, a TNF-α mutein may specifically bind to TNFR2 (a target molecule) over TNFR1 (a non-target molecule). The TNF-α mutein may have, e.g., at least 2-fold greater affinity (e.g., 2, 3, 4, 5, 6, 7, 8, 9, 10, $10^2$-, $10^3$-, $10^4$-, $10^5$-, $10^6$-, $10^7$-, $10^8$-, $10^9$-, or $10^{10}$-fold greater affinity) for TNFR2 than for TNFR1 or other TNFSF receptors.

As used herein, the term "percent (%) sequence identity" refers to the percentage of amino acid (or nucleic acid) residues of a candidate sequence, e.g., a TNFSF ligand mutein, that are identical to the amino acid (or nucleic acid) residues of a reference sequence, e.g., a wild-type TNFSF ligand, after aligning the sequences and introducing gaps, if necessary, to achieve the maximum percent sequence identity (e.g., gaps can be introduced in one or both of the candidate and reference sequences for optimal alignment and non-homologous sequences can be disregarded for comparison purposes). Alignment for purposes of determining percent sequence identity can be achieved in various ways that are within the skill in the art, for instance, using publicly available computer software such as BLAST, ALIGN or Megalign (DNASTAR) software. Those skilled in the art can determine appropriate parameters for measuring alignment, including any algorithms needed to achieve maximal alignment over the full length of the sequences being compared. In particular embodiments, a reference sequence aligned for comparison with a candidate sequence may show that the candidate sequence exhibits from 50% to 100% sequence identity across the full length of the candidate sequence or a selected portion of contiguous amino acid (or nucleic acid) residues of the candidate sequence. The length of the candidate sequence aligned for comparison purposes is at least 30%, e.g., at least 40%, e.g., at least 50%, 60%, 70%, 80%, 90%, or 100% of the length of the reference sequence. When a position in the candidate sequence is occupied by the same amino acid residue as the corresponding position in the reference sequence, then the molecules are identical at that position.

As used herein, the term "substantially identical" refers to a polypeptide or polynucleotide sequence that has the same polypeptide or polynucleotide sequence, respectively, as a reference sequence, or has a specified percentage of amino acid residues or nucleotides, respectively, that are the same at the corresponding location within a reference sequence when the two sequences are optimally aligned. For example, an amino acid sequence that is "substantially identical" to a reference sequence has at least 50%, 60%, 70%, 75%, 80%, 85%, 90%, 95%, 96%, 97%, 98%, 99%, or 100% sequence identity to the reference amino acid sequence. For polypeptides, the length of comparison sequences will generally be at least 5, 6, 7, 8, 9, 10, 11, 12, 13, 14, 15, 16, 17, 18, 19, 20, 25, 50, 75, 90, 100, 150, 200, 250, 300, or 350 contiguous amino acids or more (e.g., the full-length sequence). For nucleic acids, the length of comparison sequences will generally be at least 5, 10, 11, 12, 13, 14, 15, 16, 17, 18, 19, 20, 21, 22, 23, 24, 25, 50, 75, 100, 200, 300, 400, 500, 1000, 2000, 3000, 4000, 5000 or more contiguous nucleotides (e.g., the full-length nucleotide sequence). Sequence identity may be measured using sequence analysis software on the default setting (e.g., Sequence Analysis Software Package of the Genetics Computer Group, University of Wisconsin Biotechnology Center, 1710 University Avenue, Madison, Wis. 53705). Such software may match similar sequences by assigning degrees of homology to various substitutions, insertions, deletions, and other modifications.

As used herein, the term "subject" refers to either a non-primate (e.g., a cow, pig, horse, cat, dog, rat, etc.) or a primate (e.g., a monkey or a human), most preferably a human being. In a preferred embodiment, the subject is a normal human (e.g., having no diagnosed or obvious disease or disorder). In another preferred embodiment, the subject is a human that has an untreated (e.g., untreated but diagnosed) or treated disease or disorder.

As used herein, the term "therapeutically effective amount" refers to an amount effective to achieve the desired therapeutic effect. In particular, the therapeutic effective amount avoids adverse side effects.

As used herein, the term "treatment" refers to an approach for obtaining beneficial or desired results, such as clinical results. Beneficial or desired results can include, but are not limited to, alleviation or amelioration of one or more symptoms or conditions; diminishment of extent of disease, disorder, or condition; stabilization (e.g., not worsening) of a state of disease, disorder, or condition; prevention of spread of disease, disorder, or condition; delay or slowing the progress of the disease, disorder, or condition; amelioration of the disease, disorder, or condition; and remission (whether partial or total), whether detectable or undetectable.

DESCRIPTION OF THE DRAWINGS

FIG. 2A shows a top view of the homo-trimer. Each monomer is a S171C/G224C (amino acids 77 to 233 of SEQ ID NO: 28; corresponds to S95C and G148C of PDB ID: 1TNF) double mutant of TNF-α. The three monomers and their surface representations are shown. Each boxed region highlights the Cys-Cys bond between two monomers. C171 of monomer 1 is bound to C224 of monomer 2. C224 of monomer 1 is bound to C171 of monomer 3. C171 of monomer 2 is bound to C224 of monomer 3. FIG. 2B shows a side view of the homo-trimer. The boxed region highlights one of the Cys-Cys bonds and the inset shows the close-up view. Residues 171 and 224 are shown in stick representation. The model was generated by Modeller (v. 9.12) using the structure of mouse TNF (PDB ID: 2TNF) as the template. The pictures were created by the program PyMol.

FIG. 3A shows an analysis of wild-type soluble TNF-α and the TNF-α mutein on a Western blot. The analysis reveals wild-type soluble TNF-α remains a monomer with approximate MW of 25 kD, but the TNF-α mutein remains a stable trimer with approximate MW of 75 kD. FIG. 3B shows an expansion of human T regulatory T cells (CD4+CD25+FOXP3+) with wild-type soluble TNF-α, TNF-α mutein, or a TNFR2 antibody antagonist compared to the typical expansion with IL-2 alone. FIG. 3C shows: (i) Wild-type soluble TNF-α ("(2)") and covalent homo-trimer of TNF-α mutein ("(1)") induce CD8 T cell proliferation in a dose dependent fashion in cells obtained from ten normal subjects. The covalent homo-trimer of TNF-α mutein has higher potency on normal cells than wild-type soluble TNF-α. (ii) Wild-type soluble TNF-α ("(2)") and covalent homo-trimer of TNF-α mutein ("(1)") induce targeted CD8 autoreactive T cells death in a dose dependent fashion in cells obtained from six Type-1 diabetic subjects, followed by proliferation of the remaining non-diseased CD8 T cells at higher concentrations of TNF-α. The covalent homo-trimer of TNF-α mutein at lower concentrations showed higher potency than wild-type soluble TNF-α.

DETAILED DESCRIPTION OF THE INVENTION

Figure 1:
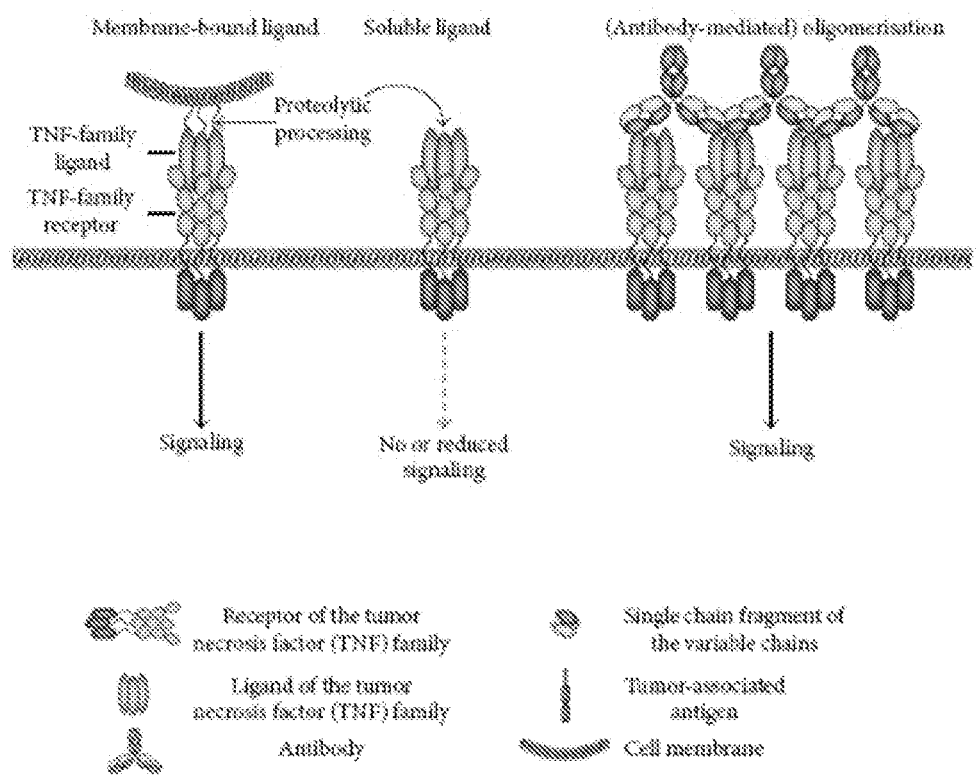
FIG. 1 from Bremer (*ISRN Oncology* 2013:371854, 2013) shows a cartoon depiction of TNFSF ligand/TNFSF receptor signaling. TNFSF ligands are typically produced as Type II transmembrane proteins, but the extracellular domain of most of these ligands can also be proteolytically cleaved by proteases into a soluble form. Typically, the soluble ligand retains binding activity but has lost some or all receptor-activating activity.

TNFSF and TNF-like ligands share the TNF homology domain and form non-covalent homo-multimers, e.g., homo-trimers, in order to bind to their respective receptors to exert signaling. These multimers naturally form when the membrane-bound TNFSF or TNF-like ligands associate. However, the dissociation of naturally occurring multimers, e.g., trimers, at low concentrations results in ligand degradation and elimination from the body. Disclosed herein is a platform technology that provides covalently cross-linked (e.g., disulfide-bonded) multimers, e.g., dimers, trimers, etc., of TNFSF and TNF-like ligands (in particular, trimers of the TNFSF ligand TNF-$\alpha$), which exhibit increased stability and improved half-life and signaling activities.

TNFSF and TNF-Like Ligand Muteins of the Invention

TNFSF and TNF-like ligand muteins of the invention contain at least two TNFSF or TNF-like ligand monomers (in particular, e.g., three monomers) that are covalently cross-linked due to the addition of at least one cysteine residue (by substitution or insertion) that promotes the formation of a disulfide bond between the at least two (e.g., three) monomers. TNFSF ligands, which are expressed naturally in a membrane bound form, can be proteolytically cleaved so that the extracellular domain is released as a soluble protein. Alternatively, a soluble form of the TNFSF ligand can be produced by recombinant or synthetic methods known in the art. The TNFSF ligand muteins of the invention include both transmembrane bound and soluble forms that form homo-multimers (e.g., homo-trimers). Preferably, the TNFSF ligand muteins are soluble (i.e., lack the transmembrane domain and, optionally, also the cytoplasmic domain (preferably both the transmembrane and cytoplasmic domains are absent)). Each TNFSF ligand mutein contains at least one cysteine residue substitution or insertion, preferably two cysteine residue substitutions or insertions. The TNFSF ligand muteins of the invention may be cross-linked to form homo-multimers when at least one cysteine residue of a TNFSF ligand mutein forms a disulfide bond with another cysteine residue on a neighboring TNFSF ligand mutein, thereby linking the two muteins through a covalent bond. In some embodiments, a disulfide bond may be formed between a substituted or inserted cysteine residue of one TNFSF ligand mutein and a substituted or inserted cysteine residue of a second TNFSF ligand mutein, between a substituted or inserted cysteine residue of one TNFSF ligand mutein and a naturally occurring cysteine residue of a second TNFSF ligand mutein, or between two naturally occurring cysteine residues of two TNFSF ligand muteins. In other embodiments, a naturally occurring cysteine residue of a TNFSF ligand may be substituted to a non-cysteine residue, e.g., a serine, to avoid undesired dimer or multimer formation caused by, e.g., non-specific disulfide bond formation, or to eliminate a naturally occurring cysteine residue that forms a disulfide bond in the wild-type TNFSF ligand. Alternatively, aside from cross-linking TNFSF ligand muteins by disulfide bonds, homo-multimers, e.g., homo-trimers, of TNFSF ligand muteins may also be formed through other means of cross-linking, such as chemical cross-linking, known in the art.

TNF-like ligands are ligands that have similar folding topologies, key amino acid residue conservations, trimer interfaces, and intron positions as those of the TNFSF ligands. The invention also features muteins of TNF-like ligands, such as the complement-1q (C1q) family of proteins (also known as TNF-related family of proteins), e.g., adiponectin, myonectin, complement-1q tumor necrosis factor-related protein 3 (C1QTNF3), and C1QTNF5. Each TNF-like ligand mutein also includes at least one cysteine residue substitution or insertion. The TNF-like ligand muteins of the invention may be cross-linked to form homo-multimers when at least one cysteine residue of a TNF-like ligand mutein forms a disulfide bond with another cysteine residue on a neighboring TNF-like ligand mutein, thereby linking the two muteins through a covalent bond. In some embodiments, a disulfide bond may be formed between a substituted or inserted cysteine residue of one TNF-like ligand mutein and a substituted or inserted cysteine residue of a second TNF-like ligand mutein, between a substituted or inserted cysteine residue of one TNF-like ligand mutein and a naturally occurring cysteine residue of a second TNF-like ligand mutein, or between two naturally occurring cysteine residues of two TNF-like ligand muteins. In other embodiments, a naturally occurring cysteine residue of a TNF-like ligand may be substituted to a non-cysteine residue, e.g., a serine, to avoid undesired dimer or multimer formation caused by, e.g., non-specific disulfide bond formation, or to eliminate a naturally occurring cysteine residue that forms a disulfide bond in the wild-type TNF-like ligand. Alternatively, aside from cross-linking TNF-like ligand muteins by disulfide bonds, homo-multimers, e.g., homo-trimers, of TNF-like ligand muteins may also be formed through other means of cross-linking, such as chemical cross-linking, known in the art.

The addition of two or more cysteine residues by substitution or insertion allows for the formation of disulfide bonded dimers, trimers, and higher order multimers. Preferably, the result is the formation of homo-trimers of TNFSF or TNF-like ligand muteins (e.g., homo-trimers of TNF-$\alpha$ muteins). Some of the TNFSF and TNF-like ligand muteins include TNF-$\alpha$, lymphotoxin (e.g., LT-$\alpha$ and LT-$\beta$), CD40L, CD70, CD153, OX40L, Fas ligand (FasL), 4-1BB ligand (4-1BBL), TRAIL, RANKL, TWEAK, APRIL, BLys, LIGHT, TL1, GITRL (also known as TL6), EDA (e.g., EDA-A1 and EDA-A2), and adiponectin. The TNFSF and TNF-like ligand muteins (full-length or fragments thereof) of the invention can be cross-linked (e.g., disulfide bonded) to form homo-multimers (e.g., homo-trimers), for example, by the formation of disulfide bonds between muteins at the newly added cysteine residue(s). In some embodiments, the TNFSF or TNF-like ligand mutein or biologically active fragment thereof has, in addition to the cysteine substitution(s) or insertion(s), at least 50% sequence identity (e.g., 50%, 55%, 60%, 65%, 70%, 75%, 80%, 85%, 90%, 95%, 99%, or 100% sequence identity) to a sequence selected from any one of SEQ ID NOs: 1-735 or a biologically fragment thereof (e.g., a fragment corresponding to the soluble portion of the TNFSF or TNF-like ligand, such as a portion lacking the transmembrane domain and, optionally, also the cytoplasmic domain (preferably both the transmembrane and cytoplasmic domains are absent)).

The UniPort Accession Nos and the PDB ID No. for each TNFSF and TNF-like ligand are listed in Table 1 and Table 2. The amino acid sequences (SEQ ID NOs: 1, 40, 76, 112, 132, 167, 203, 236, 267, 297, 333, 369, 398, 435, 467, 506, 542, 562, 590, and 688) identified by the UniPort Accession Nos. are the wild-type sequences of full-length TNFSF and TNF-like ligands. To engineer each TNFSF and TNF-like ligand mutein, the crystal structure corresponding to the PDB ID was used to identify amino acids in each TNFSF and TNF-like ligand that could be substituted with a cysteine residue. For example, a TNFSF mutein having two cysteine substitutions can form a homotrimer. Each TNFSF ligand mutein monomer interacts with two other monomers to form three identical monomer-monomer interfaces in the homotrimer. Based on available crystal structures and general knowledge in the art, the Cα-Cα bond distance between two cysteine residues in a disulfide bond ranges from 4 to 9 Å (The Anatomy and Taxonomy of Protein Structure (Richardson, 2000)). Two residues, one on each adjacent monomer, with their a carbons less than 9 Å away from each other, were identified and substituted with cysteine residues. As an example, a TNF-α mutein monomer that contains two cysteine substitutions, S171C and G224C, can be provided according to the invention. The first cysteine residue S171C on a first TNF-α mutein can form a disulfide bond with the second cysteine residue G224C on a second TNF-α mutein and the second cysteine residue G224C on the first TNF-α mutein can form a disulfide bond with the first cysteine residue S171C on a third TNF-α mutein. The first cysteine residue S171C on the second TNF-α mutein can form a disulfide bond with the second cysteine residue G224C on the third TNF-α mutein to complete the trimer. In other embodiments, specific regions on two neighboring monomers that are located in proximity to each other may be identified and cysteine insertions may be added within each region of the monomer using conventional techniques in the field (e.g., site-directed mutagenesis and protein synthesis).

In other embodiments, the TNFSF or TNF-like ligand mutein contains one or more cysteine substitutions or insertions (e.g., two substitutions or insertions) that are located within one or more of the amino acid regions listed in Table 2. As an example, the TNF-α mutein contains one or more cysteine substitutions or insertions (e.g., two substitutions or insertions) that are located within one or more of the following regions: amino acids 77-94, 107-113, 127-138, 165-204, and 220-228, relative to the amino acid sequence of SEQ ID NO: 1 (e.g., one cysteine substitution or insertion within two different regions).

For five TNFSF ligands, TNF-α, LT-α, TWEAK, TL1, and GITRL (also known as TL6), the amino acid numbering under the PBD ID Nos. is different from the amino acid numbering under the UniPort Accession Nos. For example, for TNF-α, S95C and G148C of PDB ID No. 1TNF, chain A, correspond to S171C and G224C of UniPort Accession Nos. P01375, 043647, Q9P1Q2, and Q9UIV3.

In some embodiments, TNFSF and TNF-like ligand muteins of the invention may be modified with agents, such as small molecules, peptides, or proteins to improve protein expression, increase half life, or improve therapeutic effect. In some embodiments, the modified TNFSF and TNF-like ligand muteins may be conjugated to an agent, e.g., a small molecule, a peptide, or a protein after covalent bonding (e.g., disulfide bond formation) to form a homo-multimer, e.g., a homo-trimer (TNFSF or TNF-like ligand multimers are also referred to herein as TNFSF or TNF-like ligand mutein complexes). In other embodiments, the TNFSF or TNF-like ligand muteins may first be conjugated to an agent, e.g., a small molecule, a peptide, or a protein, and then covalently bonded to form a homo-multimer, e.g., a homo-trimer. Small molecules that may be conjugated to a TNFSF or TNF-like ligand mutein or to a cross-linked TNFSF or TNF-like ligand mutein complex (e.g., a homo-trimer) include, but are not limited to, various organic small molecule drugs, e.g., anti-cancer agents that are well known in the art (see, e.g., the anticancer agents described in U.S. Pat. Nos. 8,779,008 and 8,771,966, each of which is incorporated herein by reference in its entirety). Peptides and proteins that may be conjugated to a TNFSF or TNF-like ligand mutein or to a cross-linked TNFSF or TNF-like ligand mutein complex include, but are not limited to, a linker sequence (e.g., a cleavable linker sequence), glycosylated peptides, albumin-binding peptides, antibodies (e.g., IgA, IgD, IgE, IgM, IgG (e.g., IgG1, IgG2, IgG3, IgG4), fragments of antibodies, bi-specific antibodies,), Fc domains, Fc fusion proteins, transferrin fusion proteins, and peptide-based drugs (e.g., those described in U.S. Pat. Nos. 8,772,231, 8,716,247, 8,211,656, 8,362,218, 7,833,979, 7,566,767, and 8,084,493, each of which is incorporated herein by reference in its entirety, and certain toxins). Other ways to create complex fusion proteins are described in Fusion Protein Technologies for Biopharmaceuticals: Applications and Challenges (Wiley Publishing, 2013), incorporated herein by reference.

In some embodiments, the TNFSF or TNF-like ligand mutein may be directly conjugated to an agent, such as a small molecule, a peptide, or a protein via a simple covalent bond, e.g., a peptide bond, or any kind of bond created from a chemical reaction, e.g., by chemical conjugation. In other embodiments, a linker may be used to connect the TNFSF or TNF-like ligand mutein to the agent, e.g., a small molecule, a peptide, or a protein. A linker can be a peptide, a protein, or a synthetic polymer, e.g., a polyethylene glycol (PEG) polymer. For example, when the linker is a peptide, the carboxylic acid group at the C-terminus of a TNFSF or TNF-like ligand mutein can be joined to the amino group at the N-terminus of the peptide linker and the carboxylic acid group at the C-terminus of the peptide linker can be joined to the agent. Alternatively, the amino group at the N-terminus of a TNFSF or TNF-like ligand mutein can be joined to the carboxylic acid group at the C-terminus of the peptide linker and the amino group at the N-terminus of the peptide linker can be joined to the agent. Suitable peptide linkers are known in the art, and include, for example, peptide linkers containing flexible amino acid residues such as glycine and serine, e.g., multiple or repeating motifs, of GS, GGS, GGGGS, GGSG, or SGGG. Methods that can be used to construct conjugates or fusion proteins of TNFSF or TNF-like ligand muteins and agents, such as small molecules, peptides, and proteins (e.g., full-length antibodies, Fc domains) are described in US Patent Publication Numbers US20070083006, US20130309192, US20130165389, and US20130065815, which are incorporated by reference in their entireties.

TNFSF and TNF-like ligand muteins of the invention also include muteins that act specifically as agonists or antagonists of their respective receptors. Generally, in addition to the cysteine residue substitution(s) or insertion(s), a TNFSF or TNF-like ligand mutein may contain other amino acid substitution(s) or insertion(s) that alter the binding affinities of the TNFSF or TNF-like ligand mutein to its respective receptor. Substitutions or insertions that produce agonist or antagonist TNFSF or TNF-like ligand muteins are described herein. The TNFSF and TNF-like ligand muteins may be beneficial in several therapeutic areas including, but not limited to, the treatment of autoimmune diseases, neurological diseases, cancers, infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, use in tissue or organ repair or regeneration, and use in organ transplantation procedures (e.g., to treat or reduce complications resulting from organ transplantation (e.g., graft-versus-host disease (GVHD) and graft rejection)).

TNF-α Mutein

Tumor necrosis factor (TNF)-α, a ligand of the TNF superfamily, is a pleiotropic cytokine with diverse functions in cell proliferation, inflammation, apoptosis, and morphogenesis. TNF-α is naturally expressed as a non-covalent trimeric transmembrane protein that can be cleaved to produce a soluble TNF-α trimer. TNF-α plays an important role in the immune system and has become an important target for cancer and autoimmunity. The transmembrane TNF-α and soluble TNF-α exert their functions via two receptors, TNF receptor 1 (TNFR1) and TNFR2. TNFR1 is ubiquitously expressed in the lymphoid system and in nearly all cells of the body. TNFR1 contains a cytoplasmic death domain that is responsible for apoptotic signaling. Activation of TNFR1 alone by exogenous TNF-α is systemically toxic. Ligand binding to TNFR1 activates the cytoplasmic death domain which binds to adaptor proteins TNFR1-associated death domain (TRADD) and Fas-associated death domain (FADD), triggering apoptosis. Additionally, TNF-α-induced TNFR1 signaling also activates classical nuclear factor kappa B (NFkB) proinflammatory signaling through the adaptor protein TRADD.

TNFR2 lacks the cytoplasmic death domain and has a more limited cellular expression in immune cells, endothelial cells, and certain neuronal cells. Despite not having the cytoplasmic death domain, TNFR2 plays an important role in modulating TNFR1 signaling and can shift the balance from inflammatory to apoptotic signaling. Specifically, binding of TNF-α to TNFR2 modulates TNFR1 signaling via proteasomal degradation of certain adaptor proteins. Typically, cells that express TNFR2 also express TNFR1, with the ratio of expression varying according to cell type and functional role. The ratio of the co-expression of TNFR1 and TNFR2 shifts the balance between cell survival and apoptosis. TNFR2 agonism may provide a more targeted immunotherapy with reduced toxicity because of its more limited cellular expression. TNFR2 agonists and TNF-inducers have recently emerged as new treatment strategies for autoimmune diseases, including the selective elimination of autoreactive T cells and induction of T-regulatory cells. Due to the more limited expression of TNFR2, signaling through TNFR2 provides a potentially more targeted therapy with fewer side effects. Soluble TNF-α trimer binds with low affinity to TNFR2 and signals almost exclusively through TNFR1; only transmembrane trimeric TNF-α can effectively activate TNFR2. Furthermore, the soluble TNF-α trimer tends to dissociate rapidly into monomers following its release from the membrane via proteolytic cleavage by TNF-α converting enzyme (TACE).

There are two major benefits of TNFR2 signaling. In normal T cells, activation of TNFR2 can promote cell proliferation or differentiation. In autoreactive T cells, activation of TNFR2 can favor a pathway of selective apoptosis due to a variety of protein signaling defects in those cells. For example, NFkB dysfunction in autoreactive T cells makes them selectively vulnerable to TNF-α-induced apoptosis due to the inability to activate pro-survival genes. Studies have shown that an agonist of TNFR2 can selectively destroy autoreactive T cells, but not healthy T cells in blood samples from patients of Type-1 diabetes (Bremer, *ISRN Oncology* 2013:1-25, 2013; Faustman et al., *Frontiers In Immuno.* 4:1-8, 2013). TNFR2 agonists have also been shown to selectively kill autoreactive T cells in patients with other types of disease, such as multiple sclerosis, Graves' Disease, and Sjögren's Syndrome (Bremer, *ISRN Oncology* 2013:1-25, 2013; Faustman et al., *Frontiers In Immuno.* 4:1-8, 2013). Activation of TNFR2 has been explored as a therapeutic method for treating autoimmune diseases and cancers. In addition, antagonists to TNFR1, which bias signaling molecules, e.g., TNF-α, to act solely through TNFR2, have also been explored as a method of selective TNFR2 signaling. Thus, stable forms of TNF-α that specifically activate TNFR2 signaling may exhibit useful therapeutic benefits.

Cross-linked (e.g., disulfide bonded) TNF-α mutein complexes of the invention include at least two TNF-α muteins (e.g., two, three, four, five, six, seven, eight, nine, or ten muteins, preferably three muteins). Each TNF-α mutein of the complex includes at least one cysteine residue substitution or insertion that allows formation of a disulfide bond with a cysteine residue on a neighboring TNF-α mutein. The TNF-α mutein may be a transmembrane domain-containing TNF-α (i.e., a membrane bound form of TNF-α) or a soluble TNF-α. Preferably, the TNF-α mutein is a soluble TNF-α lacking the transmembrane domain and optionally, also the cytoplasmic domain (preferably both the transmembrane and cytoplasmic domains are absent). Each TNF-α mutein is covalently bonded (e.g., disulfide bonded) to a neighboring TNF-α mutein in the complex. In some embodiments, a disulfide bond may be formed between substituted cysteine residues on neighboring TNF-α muteins, between a substituted cysteine residue and a naturally occurring cysteine residue on neighboring TNF-α muteins, or between naturally occurring cysteine residues on neighboring TNF-α muteins. Multimers of TNF-α muteins of the invention are composed of two, three, four, or more, preferably three, TNF-α muteins or biologically active fragments thereof. Preferably, the TNF-α muteins are the same (e.g., homo-multimers, such as homo-trimers), although the invention also includes hetero-multimers (e.g., hetero-trimers) of TNF-α muteins. In some embodiments, each TNF-α mutein or fragment thereof has at least one cysteine substitution or insertion (e.g., 2, 3, 4, or more cysteine substitution or insertion, preferably 2) and has at least 50% sequence identity (e.g., 50%, 55%, 60%, 65%, 70%, 75%, 80%, 85%, 90%, 95%, 99%, or 100%) to a sequence selected from any one of SEQ ID NOs: 1-39 and 624-638 or a biologically active fragment thereof.

In one embodiment, the TNF-α mutein is a soluble TNF-α mutein that forms a TNF-α homo-trimer in which each monomer contains cysteine substitutions that replace two naturally occurring amino acid residues (i.e., non-cysteine residues) with cysteine residues or one or more cysteine insertions. In some embodiments, the TNF-α mutein contains one or more of the following cysteine substitutions: R82C, T83C, P84C, S85C, H91C, N110C, G130C, L131C, Y135C, N168C, L169C, L170C, S171C, A172C, I173C, K174C, S175C, Q178C, E180C, W190C, Y191C, P193C, G198C, V199C, F200C, Q201C, S223C, G224C, and Q225C, relative to SEQ ID NO: 1. In some embodiments, the TNF-α mutein contains one or more (preferably one) of the following pairs of cysteine substitutions: G130C/S85C, L131C/T83C, L131C/P84C, S171C/G224C, N168C/S223C, N168C/G224C, L169C/S223C, L169C/G224C, L170C/S223C, S171C/S223C, S171C/Q225C, A172C/P193C, I173C/Y191C, I173C/P193C, K174C/Y191C, S175C/W190C, S175C/Y191C, Q178C/E180C, G198C/Y135C, V199C/H91C, F200C/H91C, F200C/N110C, Q201C/R82C, and Q201C/T83C, relative to SEQ ID NO: 1. In one embodiment, the TNF-α mutein includes substitutions S171C and/or G224C, such that S171C on one mutein could form a covalent disulfide bond with G224C on a neighboring TNF-α mutein. In other embodiments, the TNF-α mutein contains one or more cysteine substitutions or insertions (e.g., two substitutions or insertions) that are located within one or more of the following regions: amino acids 77-94, 107-113, 127-138, 165-204, and 220-228, relative to the amino acid sequence of SEQ ID NO: 1 (e.g., one cysteine substitution or insertion within two different regions). The amino acid numbering is relative to the wild-type TNF-α sequence (e.g., SEQ ID NO: 1; UniProt Accession NOs: P01375, 043647, Q9P1Q2, and Q9UIV3).

Amino acid residue Ser171 of TNF-α (corresponding to S95 of PDB ID: 1TNF, chain A) sits on a structurally conserved β strand. The amino acid change from Ser to Cys is chemically conserved such that the substitution is unlikely to cause any disturbance in TNF-α secondary or tertiary structure or function. Amino acid residue Gly224 of TNF-α (corresponding to G148 in PDB ID: 1TNF, chain A) is located at the edge of loop 221-223 that participates in receptor binding, but Gly224 itself is not involved in receptor interaction. A comparison of known wild-type soluble TNF-α structures shows that amino acid residue 224 moves little between free and receptor bound forms, thus maintaining the ideal distance with amino acid residue 171 for disulfide bond formation at all times. In addition, unlike bulky external additions or chemical cross-linkers, amino acid residues S171 and G224 (corresponding to S95 and G148 of PDB ID: 1TNF, chain A) are hidden from the surface in the TNF-α homo-trimer (FIG. 2). Thus, it is unlikely that substitutions at these residues would induce immunogenicity or cause toxicity. FIG. 2 shows the covalent homo-trimer of TNF-α formed from three monomers of the S171C/G224C (S95/G148) double cysteine TNF-α mutein.

TNF-α muteins of the invention, e.g., when they form a homo-trimer, may act as a receptor agonist or antagonist (e.g., an agonist of TNFR2 or TNFR1, preferably an agonist of TNFR2). In addition to the cysteine residue substitutions or insertions, the TNF-α mutein may contain other amino acid substitutions or insertions that change the binding affinity of the TNF-α mutein, e.g., such that the TNF-α mutein preferentially binds to TNFR2 over TNFR1 or vice versa. For example, TNF-α muteins having one or more of the amino acid substitutions Q67K, A145F, and A145R, are agonists of TNFR2. The covalently cross-linked (e.g., disulfide bonded) homo-trimers of TNF-α having one or more of these substitutions exhibit the ability to induce CM' cell death and to promote the proliferation of T-regulatory cells, both via TNFR2 signaling.

T-regulatory cells are a type of immunosuppressive cell that displays diverse clinical applications in transplantation, allergy, infectious disease, GVHD, autoimmunity, and cancer. T-regulatory cells have been proposed to prevent or treat autoimmune diseases, but the rate-limiting problem has been obtaining sufficient quantities of T-regulatory cells, whether by generating them ex vivo or stimulating their production in vivo. Activation of TNFR2 signaling has been demonstrated to induce differentiation of CD4 T cells to T-regulatory cells, which is characterized most commonly by the co-expression of CD25 and the transcription factor forkhead box P3 (FOXP3) intracellular protein.

To test the function of a TNF-α mutein of the invention (e.g., a TNF-α homo-trimer), CD4 T cells may be contacted with the TNF-α mutein homo-trimer and the activity may be compared to the activity of a non-covalently bound TNF-α homo-trimer or wild-type, soluble TNF-α monomer. Downstream expressions of CD25 and high density FOXP3 intracellular protein may be analyzed by flow cytometry (FIG. 3B).

Diseases and disorders that may be treated with the TNF-α mutein of the invention (e.g., a TNF-α mutein homo-trimer) include, but are not limited to, cancers (e.g., those described in US Patent Publication Number US20100305199 and WO2013186329), inflammatory diseases (e.g., those described in US Patent Publication Numbers US20120329846 and US20100016232), nerve disorders (e.g., those described in US Patent Publication Numbers US20010055594 and US 20120093816), and autoimmune disorders (e.g., those described in U.S. Pat. No. 7,101,974). The contents of the referenced patent and patent publication numbers are incorporated herein by reference in their entireties.

In some embodiments, a disulfide-bonded homo-trimeric TNF-α mutein complex containing three TNF-α muteins (e.g., a complex in which each monomer contains the S171C and G224C substitutions), may be used to treat autoimmune diseases, such as Alopecia Areata, Ankylosing Spondylitis, Antiphospholipid Syndrome, Addison's Disease, Hemolytic Anemia, Autoimmune Hepatitis, Hepatitis, Behcets Disease, Bullous Pemphigoid, Cardiomyopathy, Celiac Sprue-Dermatitis, Chronic Fatigue Immune Dysfunction Syndrome (CFIDS), Chronic Inflammatory Demyelinating Polyneuropathy, Churg-Strauss Syndrome, Cicatricial Pemphigoid, Limited Scleroderma (CREST Syndrome), Cold Agglutinin Disease, Crohn's Disease, Discoid Lupus, Essential Mixed Cryoglobulinemia, Fibromyalgia-Fibromyositis, Graves' Disease, Guillain-Barré Syndrome, Hashimoto's Thyroiditis, Hypothyroidism, Inflammatory Bowel Disease, autoimmune lymphoproliferative syndrome (ALPS), Idiopathic Pulmonary Fibrosis, Idiopathic Thrombocytopenia Purpura (ITP), IgA Nephropathy, Insulin dependent Diabetes, Juvenile Arthritis, Lichen Planus, Lupus, Meniere's Disease, Mixed Connective Tissue Disease, Multiple Sclerosis, Myasthenia Gravis, Pemphigus Vulgaris, Pernicious Anemia, Polyarteritis Nodosa, Polychondritis, Polyglandular Syndromes, Polymyalgia Rheumatica, Polymyositis, Dermatomyositis, Primary Agammaglobulinemia, Primary Biliary Cirrhosis, Psoriasis, Raynaud's Phenomenon, Reiter's Syndrome, Rheumatic Fever, Rheumatoid Arthritis, Sarcoidosis, Scleroderma, Sjögren's Syndrome, Stiff-Man Syndrome, Takayasu Arteritis, Temporal Arteritis/Giant Cell Arteritis, Ulcerative Colitis, Uveitis, Vasculitis, Vitiligo, and Wegener's Granulomatosis. Preferably, the autoimmune disease to be treated with the TNF-a mutein homo-trimer (e.g., a homo-trimer in which each TNF-α mutein has a S171C/G224C substitution) is insulin dependent diabetes (also known as type 1 diabetes or autoimmune diabetes), multiple sclerosis, rheumatoid arthritis, Sjögren's syndrome, Crohn's disease, thyroiditis, lupus, or dermatitis. Administration of a pharmaceutical composition containing a disulfide-bonded homo-trimeric TNF-α mutein treats the autoimmune disease by selectively killing autoreactive T cells and/or promoting the proliferation of T-regulatory cells. TNF-α muteins of the invention can also be administered in combination with other therapies for autoimmune disease, e.g., *Bacillus* Calmette-Guérin (BCG).

In some embodiments, a disulfide-bonded homo-trimeric TNF-α mutein complex containing three TNF-α muteins (e.g., a complex in which each monomer contains S171C and G224C substitutions) may be used to treat neurological diseases, such as a brain tumor, a brain metastasis, schizophrenia, epilepsy, amyotrophic lateral sclerosis (ALS), Parkinson's disease, Alzheimer's disease, Huntington's disease, and stroke. Preferably, the neurological disease is amyotrophic lateral sclerosis (ALS), Parkinson's disease, or Alzheimer's disease.

In some embodiments, a disulfide-bonded homo-trimeric TNF-α mutein complex containing three TNF-α muteins (e.g., a complex in which each monomer contains S171C and G224C substitutions) may be used to reduce or eliminate the risk and complications associated with cell, tissue, or organ rejection, e.g., graft-versus-host disease (GVHD) and graft rejection, and to provide better engraftment of a transplanted cell, tissue, or organ. Examples of transplant patients are those that are receiving or have received a heart, heart valve, blood vessel (e.g., artery or vein), kidney, liver, lung, or lung lobe, pancreas, ovary, bladder, stomach, testis, intestine, thymus, bone, tendon, cornea, skin, nerve, hand, arm, foot, leg, or cellular (e.g., beta-islet cells, stem or pluripotent cells (e.g., hematopoietic stem cells (HSC), such as CD34+ stem cells, e.g., from bone marrow, mesenchymal stem cells (MSCs), and Hox11+ cells) transplant. The transplant patient may also have received an autologous, allogeneic, or syngeneic cell transplant.

In other embodiments, a disulfide-bonded homo-trimeric TNF-α mutein complex containing three TNF-α muteins (e.g., a complex in which each monomer contains S171C and G224C substitutions) may be used to repair or regenerate an organ or tissue (e.g., in an autoimmune disease patient in which the organ or tissue is targeted by autoreactive $CD8^+$ T cells). Administration of the TNF-α homotrimer kills the autoreactive $CD8^+$ T cells, which allows the organ or tissue to regenerate. In an embodiment, the TNF-α homo-trimer may be administered in a combination therapy, which includes co-administration (either together or separate) of pluripotent cells (e.g., MSCs, HSCs, or $Hox11^+$ cells (see, e.g., U.S. Pat. Nos. 8,017,392 and 8,021,693, each of which is incorporated herein by reference in its entirety). Administration of the TNF-α mutein complex can be used to repair or regenerate an organ or tissue selected from the group consisting of a heart, heart valve, blood vessel (e.g., artery or vein), kidney, liver, lung, or lung lobe, pancreas, ovary, bladder, stomach, testis, intestine, thymus, bone, tendon, cornea, skin, nerve, hand, arm, foot, and leg. The TNF-α mutein complex can also be administered to patients who are receiving or who have received cellular therapy (e.g., administration of beta-islet cells, stem or pluripotent cells (e.g., hematopoietic stem cells (HSC), such as $CD34^+\times$ stem cells, e.g., from bone marrow, mesenchymal stem cells (MSCs), and $Hox11^+$ cells).

In other embodiments, TNF-α muteins with increased binding affinity for TNFR2, e.g., TNF-α muteins (e.g., as a homo-trimeric complex), such as TNF-α muteins with substitutions (e.g., Q67K, A145F, and A145R) in addition to those described above (e.g., S171C and G224C), may be used to treat the aforementioned autoimmune diseases (e.g., type 1 diabetes, rheumatoid arthritis, Sjögren's syndrome, multiple sclerosis, and Crohn's disease) and neurological diseases (e.g., amyotrophic lateral sclerosis (ALS), Parkinson's disease, and Alzheimer's disease) as well as for organ and tissue regeneration and repair and to treat complications associated with cell, tissue, or organ rejection (e.g., graft-versus-host disease (GVHD) and graft rejection).

In still other embodiments, a disulfide-bonded homo-trimeric TNF-α mutein complex containing three TNF-α muteins (e.g., a complex in which each monomer contains the S171C and G224C substitutions), may be used to treat infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, and obesity.

In particular, a disulfide-bonded homo-trimeric TNF-α mutein complex containing three TNF-α muteins (e.g., a complex in which each monomer contains the S171C and G224C substitutions), may be used to treat type 1 diabetes, Sjögren's Syndrome, multiple sclerosis, inflammatory bowel disease, rheumatoid arthritis, diseases related to miscarriage, and cancer.

In some embodiments, a disulfide-bonded homo-trimeric TNF-α mutein complex containing three TNF-α muteins (e.g., a complex in which each monomer contains S171C and G224C substitutions) may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a TNF-α mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al., *Cancer Immun.*, 12:14-21, 2012, which is incorporated herein by reference in its entirety. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TNF-α cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAGS may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a disulfide-bonded homo-trimeric TNF-α mutein complex containing three TNF-α muteins (e.g., a complex in which each monomer contains S171C and G224C substitutions) may be fused to a cancer antigen-specific antibody for targeted delivery of the complex and treatment of cancers expressing the cancer antigen.

FasL Mutein

Fas ligand (FasL) is a type II transmembrane protein expressed on immune effector cells, such as T cells. The main receptor for FasL is the type I transmembrane receptor Fas, which is expressed on a variety of normal human cells as a homo-trimer. Binding of FasL to Fas triggers Fas oligomerization and initiates downstream apoptotic signaling pathway. Additionally, NFkB-mediated proinflammatory signaling can also be induced by FasL. Like most TNFSF ligands, the extracellular domain of transmembrane FasL is subject to proteolytic cleavage, which generates soluble homo-trimeric FasL. Because soluble trimeric FasL is unstable and constantly degraded by proteases, it is approximately 1000-fold less effective in inducing Fas signaling than transmembrane FasL. The signaling of FasL/Fas as cytolytic pathway in T-cell immunity has been applied in cancer immunotherapy. Studies have shown that compartmentalized activation of Fas signaling (e.g., intraperitoneal administration of FasL) proved to be effective in eliminating murine lymphoma cells in the absence of toxicity (Rensing-Ehl et al., *European Journal of Immunology* 25:2253-2258, 1995). In designing more selective Fas agonists, recombinant hexameric forms of FasL (e.g., fusing FasL to the Fc portion of an immunoglobulin or to the collagen domain of ACRP30/adiponectin), such as Fc-FasL or mega-FasL, have been shown to be capable of activating Fas-apoptotic signaling (Holler et al., *Molecular and Cellular Biology* 23:1428-1440, 2003; Greaney et al., *Leukemia Research* 30:415-426, 2006).

FasL muteins of the invention include at least two FasL muteins (e.g., two, three, four, five, six, seven, eight, nine, or ten muteins, preferably three muteins). Each FasL mutein includes at least one cysteine residue substitution or insertion that promotes the formation of a disulfide bond with a cysteine residue on a neighboring FasL mutein. The FasL mutein may be a transmembrane FasL or soluble FasL. Preferably, the FasL mutein is a soluble FasL lacking the transmembrane domain. Each FasL mutein is disulfide bonded to a neighboring FasL mutein. In some embodiments, a disulfide bond may be formed between substituted cysteine residues on neighboring FasL muteins, between a substituted cysteine residue and a naturally occurring cysteine residue on neighboring FasL muteins, or between naturally occurring cysteine residues on neighboring FasL muteins. Multimers of FasL muteins of the invention are composed of two, three, four, or more, preferably three, FasL muteins or fragments thereof. In some embodiments, each FasL mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 167-202 and 651-653 or a biologically active fragment thereof (e.g., a fragment lacking the transmembrane domain and, optionally, also the cytoplasmic domain, or both domains).

Preferably, the FasL mutein is a soluble FasL mutein that forms a FasL homo-trimer in which each monomer contains cysteine substitutions that replace two naturally occurring amino acid residues (i.e., non-cysteine residues) with cysteine residues or one or more cysteine insertions. In some embodiments, the FasL mutein contains one or more of the following cysteine substitutions: H148C, I168C, Y192C, V223C, M224C, M225C, E226C, G227C, K228C, M229C, M230C, W239C, A240C, S242C, A247C, V248C, F249C, E271C, S272C, and Q273C, relative to SEQ ID NO: 167. In some embodiments, the FasL mutein contains one or more (preferably one) of the following pairs of cysteine substitutions: V223C/E271C, V223C/S272C, M224C/E271C, M224C/S272C, M225C/E271C, E226C/E271C, E226C/S272C, E226C/Q273C, G227C/S242C, K228C/A240C, K228C/S242C, M229C/A240C, M230C/W239C, M230C/A240C, A247C/Y192C, V248C/H148C, F249C/H148C, and F249C/I168C, relative to SEQ ID NO: 167. In other embodiments, the FasL mutein contains one or more cysteine substitutions or insertions (e.g., two substitutions or insertions) that are located within one or more of the following regions: amino acids 134-151, 165-171, 189-195, 220-252, and 268-276, relative to the amino acid sequence of SEQ ID NO: 167 (e.g., one cysteine substitution or insertion within two different regions). The amino acid numbering is relative to the wild-type FasL sequence (e.g., SEQ ID NO: 167; UniProt Accession NOs: P48023 and Q9BZP9).

Diseases and disorders that may be treated with FasL muteins of the invention include, but are not limited to, immune system-related diseases (e.g., those described in US Patent Numbers U.S. Pat. Nos. 5,759,536 and 6,046,310), cancers (e.g., those described in U.S. Pat. No. 6,451,759), and complications resulting from tissue or organ transplantation (e.g., those described in U.S. Pat. No. 5,858,990). The contents of the referenced patent and patent publication numbers are incorporated herein by reference in their entireties. In some embodiments, the FasL mutein of the invention may induce oligomerization of trimeric Fas receptors and activate downstream apoptotic pathway to selectively kill cancerous cells.

In particular, a disulfide-bonded homo-trimeric FasL mutein complex containing three FasL muteins may be used to treat autoimmune lymphoproliferative syndrome (ALPS), oral squamous cell carcinoma, neuroblastoma, rheumatoid arthritis, and cancers.

In some embodiments, a disulfide-bonded homo-trimeric FasL mutein complex containing three FasL muteins may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a FasL mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a FasL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a disulfide-bonded homo-trimeric FasL mutein complex containing three FasL muteins may be fused to a cancer antigen-specific antibody for targeted delivery of the complex and treatment of cancers expressing the cancer antigen.

TRAIL Mutein

Tumor necrosis factor apoptosis inducing ligand (TRAIL) is another member of the TNFSF. TRAIL is expressed on various immune effector cells and binds to four receptors of the TNF receptor family, TRAIL-R1, TRAIL-R2, TRAIL-R3, and TRAIL-R4. TRAIL-R1 and TRAIL-R2 contain the characteristic cytoplasmic death domains for induction of apoptosis. Apoptotic signaling by TRAIL via TRAIL-R1 and TRAIL-R2 is similar to Fas-induced apoptotic signaling. Additionally, TRAIL can also trigger proinflammatory NFkB-signaling. TRAIL and other TRAIL receptor agonists have been shown to exhibit tumoricidal activities with little associated toxicity. The soluble form of TRAIL has activity towards TRAIL-R1 but it cannot efficiently activate TRAIL-R2, perhaps due to inefficient oligomer formation of TRAIL and TRAIL-R2. Clinical data show that soluble TRAIL is safe to use with little or no toxicity, but has sub-optimal apoptotic activity. Depending on the relative contribution of the agonistic TRAIL receptors within a type of tumor, engineered soluble TRAIL variants that can selectively activate TRAIL-R1 or TRAIL-R2 may be useful in enhancing tumoricidal activity. Methods of preparing proteins that specifically act as TRAIL-R2 agonists are described in US Patent Publication Number US20090131317, which is incorporated by reference in its entirety.

TRAIL muteins of the invention include homo-multimers of TRAIL muteins. Each TRAIL mutein includes at least one cysteine residue substitution or insertion that promotes the formation of a disulfide bond with a cysteine residue on a neighboring TRAIL mutein. The TRAIL mutein may be a transmembrane TRAIL or soluble TRAIL. Preferably, the TRAIL mutein is a soluble TRAIL lacking the transmembrane domain. In some embodiments, the TRAIL mutein of the invention may act as an agonist of TRAIL-R1 or TRAIL-R2. In some embodiments, a disulfide bond may be formed between substituted cysteine residues on neighboring TRAIL muteins, between a substituted cysteine residue and a naturally occurring cysteine residue on neighboring TRAIL muteins, or between naturally occurring cysteine residues on neighboring TRAIL muteins. Multimers of TRAIL muteins of the invention are composed of two, three, four, or more, preferably three, TRAIL muteins or fragments thereof. In some embodiments, each TRAIL mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 297-332, 621, 623, 660-662, and 734.

Preferably, the TRAIL mutein is a soluble TRAIL mutein that forms a TRAIL homo-multimer in which each monomer contains cysteine substitutions that replace two naturally occurring amino acid residues (i.e., non-cysteine residues) with cysteine residues or one or more cysteine insertions. In some embodiments, the TRAIL mutein contains one or more of the following cysteine substitutions: H125C, L147C, H161C, Y185C, L221C, L222C, M223C, K224C, S225C, A226C, R227C, N228C, C230S, G238C, L239C, S241C, G246C, I247C, H270C, E271C, and A272C, relative to SEQ ID NO: 297. In some embodiments, the TRAIL mutein contains one or more (preferably one) of the following pairs of cysteine substitutions: L221C/H270C, L221C/E271C, L222C/H270C, L222C/E271C, M223C/H270C, K224C/H270C, K224C/E271C, K224C/A272C, S225C/S241C, A226C/L239C, A226C/S241C, R227C/L239C, N228C/G238C, N228C/L239C, G246C/Y185C, I247C/H125C, and L147C/H161C, relative to SEQ ID NO: 297. In other embodiments, the TRAIL mutein contains one or more cysteine substitutions or insertions (e.g., two substitutions or insertions) that are located within one or more of the following regions: amino acids 111-128, 144-150, 158-164, 182-188, 218-250, and 267-275, relative to the amino acid sequence of SEQ ID NO: 297 (e.g., one cysteine substitution or insertion within two different regions). In other embodiments, a naturally occurring cysteine residue of a TRAIL mutein, e.g., residue C230, may be mutated to a serine residue in order to avoid undesired dimerization. The amino acid numbering is relative to the wild-type TRAIL sequence (e.g., SEQ ID NO: 297; UniProt Accession NOs: P50591 and A1Y9B3).

Diseases and disorders that may be treated with TRAIL muteins of the invention include, but are not limited to, cancers (e.g., those described in US Patent Publication Number US20110165265 and WO2009140469, and U.S. Pat. No. 7,736,637), autoimmune diseases (e.g., those described in US Patent Publication Number US20130065815), and metabolic diseases (e.g., those described in US Patent Publication Number US20130345116). The contents of the referenced patent and patent publication numbers are incorporated herein by reference in their entireties. In some embodiments, covalently cross-linked multimers of TRAIL may be able to efficiently activate TRAIL-R1 and TRAIL-R2 oligomerization and apoptotic signaling in cancerous cells.

In particular, TRAIL muteins of the invention may be used in cancer therapy (e.g., a cancer combination therapy with a chemotherapy agent, an immunotherapy agent, or radiation), such as in the treatment of solid tumors (e.g., breast cancer, pancreatic cancer, brain cancer, colon cancer, and those described in Falschlehner et al, *Adv Exp Med Biol.* 647:195-206, 2009, which is incorporated herein by reference in its entirety). Tumor cells that may be treated with TRAIL muteins of the invention include, e.g., non-small cell lung carcinoma, non-Hodgkin's lymphoma, erythroleukemic cells, acute myeloid leukemia (AML), soft tissue sarcoma, melanoma (see, e.g., Table 1 of Falschlehner et al.). In some embodiments, TRAIL muteins of the invention may be used in combination with one or more chemotherapy agents (see, e.g., Tables 1, 2, and 3 of Falschlehner et al.) in cancer therapy (e.g., in the treatment of solid tumors (e.g., advanced solid tumors)). In some embodiments, TRAIL muteins of the invention may be used autoimmune diseases (e.g., multiple sclerosis) and inflammation.

In some embodiments, a TRAIL mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a TRAIL mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TRAIL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a TRAIL mutein may be fused to a cancer antigen-specific antibody for targeted delivery of the complex and treatment of cancers expressing the cancer antigen.

CD40L Mutein

CD40L is a type II transmembrane protein expressed on monocytes, activated B-cells, epithelial cells, endothelial cells, platelets, and smooth muscle cells. The main function of CD40L and its cognate receptor CD40 is to activate dendritic cells (DCs) to prime effective cytotoxic CD8$^+$ T-cell responses. The main aim of therapeutic targeting of CD40 has been to induce efficient DC-mediated priming of T-cell immunity and ensure induction of effective antitumor T-cell immune responses. Accumulating evidence indicates that CD40 signaling is only initiated when CD40 is clustered within the membrane of target cells. Studies have shown that a cross-linked trimer of FLAG-tagged soluble CD40L was able to trigger CD40 signaling (Fick et al., *Journal of Immuno.* 183:1851-1861, 2009). In line with this finding, a hexameric form of soluble CD40L was able to activate DCs and induce T-cell responses.

CD40L muteins of the invention include homo-multimers of CD40L muteins. Each CD40L mutein includes at least one cysteine residue substitution or insertion that promotes the formation of a disulfide bond with a cysteine residue on a neighboring CD40L mutein. The CD40L mutein may be a transmembrane CD40L or soluble CD40L. Preferably, the CD40L mutein is a soluble CD40L lacking the transmembrane domain. In some embodiments, a disulfide bond may be formed between substituted cysteine residues on neighboring CD40L muteins, between a substituted cysteine residue and a naturally occurring cysteine residue on neighboring FasL muteins, or between naturally occurring cysteine residues on neighboring FasL muteins. Multimers of CD40L muteins of the invention are composed of two, three, four, or more, preferably six, CD40L muteins or fragments thereof. In some embodiments, each CD40L mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 132-166, 620, 648-650, and 723-727.

Preferably, the CD40L mutein is a soluble CD40L mutein that forms a CD40L homo-multimer, e.g., homo-hexamer, in which each mutein contains cysteine substitutions that replace two naturally occurring amino acid residues (i.e., non-cysteine residues) with cysteine residues or one or more cysteine insertions. In some embodiments, the CD40L mutein contains one or more of the following cysteine substitutions: H125C, Y145C, Y172C, I204C, L205C, L206C, R207C, A208C, A209C, N210C, T211C, S213C, K216C, P217C, G219C, Q220C, S222C, G227C, V228C, F229C, T251C, G252C, and F253C, relative to SEQ ID NO: 132. In some embodiments, the CD40L mutein contains one or more (preferably one) of the following pairs of cysteine substitutions: I204C/T251C, I204C/G252C, L205C/T251C, L205C/G252C, L206C/T251C, R207C/T251C, R207C/G252C, R207C/F253C, A208C/S222C, A209C/Q220C, A209C/S222C, N210C/Q220C, T211C/G219C, T211C/Q220C, S213C/K216C, S213C/P217C, G227C/Y172C, V228C/H125C, F229C/H125C, and F229C/Y145C, relative to SEQ ID NO: 132. In other embodiments, the CD40L mutein contains one or more cysteine substitutions or insertions (e.g., two substitutions or insertions) that are located within one or more of the following regions: amino acids 111-128, 142-148, 169-175, 201-232, and 248-256, relative to the amino acid sequence of SEQ ID NO: 132 (e.g., one cysteine substitution or insertion within two different regions). The amino acid numbering is relative to the wild-type CD40L sequence (e.g., SEQ ID NO: 132, UniProt Accession NO: P29965).

Pharmaceutical compositions containing CD40L muteins of the invention may be used in immunotherapy (e.g., those described in US Patent Publication Number US20030031668), treatments of cancers (e.g., those described in US Patent Publication Number US 20010018041), and treatments of tissue or organ transplantation rejections (e.g., those described in WO2005044854). The contents of the referenced patent publication numbers are incorporated herein by reference in their entireties.

In particular, CD40L muteins of the invention may be used for the treatment of Sjögren's Syndrome, allergies, atherosclerosis, breast cancer, and type 1 diabetes.

In some embodiments, a CD40L mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a CD40L mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a CD40L cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a CD40L mutein may be fused to a cancer antigen-specific antibody for targeted delivery of the complex and treatment of cancers expressing the cancer antigen.

CD70 Mutein

The ligand CD70 is a type II homo-trimeric transmembrane ligand. The expression of CD70 on normal cells is restricted to activated T- and B-lymphocytes and mature DCs. The cognate receptor for CD70 is CD27, a type I transmembrane receptor expressed on native T cells, mature T-cells, memory B-cells, and NK-cells. CD27 is expressed as a homodimer on the cell surface, suggesting that functional CD70/CD27 interaction occurs at least in a hexameric form of CD70. The key biological function of CD70 is to efficiently prime CD4+ and CD8+ T cell responses, to enhance T-cell survival, and to optimize effector function. Many types of hematological and solid tumors have been documented to express CD70 on the cell surface, whereas CD70 is only transiently expressed on antigen-activated lymphocytes. This expression pattern establishes CD70 as a potential target for antibody-based cancer therapy. In some embodiments, the invention features covalently cross-linked multimers of CD70.

CD70 muteins of the invention include homo-multimers of CD70 muteins. Each CD70 mutein includes at least one cysteine residue substitution or insertion that promotes the formation of a disulfide bond with a cysteine residue on a neighboring CD70 mutein. The CD70 mutein may be a transmembrane CD70 or soluble CD70. Preferably, the CD70 mutein is a soluble CD70 lacking the transmembrane domain. In some embodiments, a disulfide bond may be formed between substituted cysteine residues on neighboring CD70 muteins, between a substituted cysteine residue and a naturally occurring cysteine residue on neighboring CD70 muteins, or between naturally occurring cysteine residues on neighboring CD70 muteins. Multimers of CD70 muteins of the invention are composed of two, three, four, or more, preferably six, CD70 muteins or fragments thereof. In some embodiments, each CD70 mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 203-235 and 654-656.

Preferably, the CD70 mutein is a soluble CD70 mutein that forms a CD70 homo-multimer, e.g., homo-hexamer, in which each monomer contains cysteine substitutions that replace two naturally occurring amino acid residues (i.e., non-cysteine residues) with cysteine residues or one or more cysteine insertions. In some embodiments, the CD70 mutein contains one or more of the following cysteine substitutions: R83C, H107C, T127C, L128C, A129C, V130C, G131C, I132C, S134C, S137C, S139C, Q149C, G150C, C151S, T152C, R157C, T159C, T181C, D182C, and E183C, relative to SEQ ID NO: 203. In some embodiments, the CD70 mutein contains one or more (preferably one) of the following pairs of cysteine substitutions: T127C/T181C, T127C/D182C, L128C/T181C, L128C/D182C, A129C/T181C, V130C/T181C, V130C/D182C, V130C/E183C, G131C/T152C, I132C/G150C, I132C/T152C, S134C/Q149C, S134C/G150C, S137C/5139, G150C/C151S, R157C/H107C, and T159C/R83C, relative to SEQ ID NO: 203. In other embodiments, the CD70 mutein contains one or more cysteine substitutions or insertions (e.g., two substitutions or insertions) that are located within one or more of the following regions: amino acids 69-86, 104-110, 124-162, and 178-186, relative to the amino acid sequence of SEQ ID NO: 203 (e.g., one cysteine substitution or insertion within two different regions). In other embodiments, a naturally occurring cysteine residue of a CD70 mutein, e.g., residue C151, may be mutated to a serine residue in order to avoid undesired dimerization. The amino acid numbering is relative to the wild-type CD70 sequence (e.g., SEQ ID NO: 203, UniProt Accession NOs: P32970, Q53XX4, and Q96J57).

Pharmaceutical compositions containing CD70 muteins of the invention may be used to treat immune disorders (e.g., those described in U.S. Pat. No. 8,647,624), cancers (e.g., those described in U.S. Pat. Nos. 8,535,678 and 8,609,104), and inflammatory diseases (e.g., those described in US Patent Publication Number US 20050191299). The contents of the referenced patent and patent publication numbers are incorporated herein by reference in their entireties.

In particular, CD70 muteins of the invention may be used for the treatment of rheumatoid arthritis, contact dermatitis, asthma, GVHD, psoriasis, and oral cancer (e.g., oral squamous cell carcinoma).

In some embodiments, a CD70 mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a CD70 mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a CD70 cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody;

immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a CD70 mutein may be fused to a cancer antigen-specific antibody for targeted delivery of the complex and treatment of cancers expressing the cancer antigen.

4-1 BB Ligand Mutein

Both the 4-1BB ligand and its receptor 4-1BB are naturally occurring type II transmembrane homo-trimers. However, activation of 4-1BB with 4-1BB ligand requires oligomerization, with trimeric soluble 4-1BB ligand being approximately 100-fold less active than oligomerized 4-1BB ligand. FIG. 1B shows a hypothetical graph of the signaling requirements of 4-1BB-signaling by 4-1BB ligand. The 4-1BB ligand is predominantly expressed on activated antigen presenting cells, such as DCs, B-cells, and macrophages. The receptor 4-1BB is an inducible co-stimulatory receptor expressed on activated T-cells as well as activated NK-cells. The 4-1BB ligand/4-1 BB signaling has been a prime target for cancer immunotherapy. Studies have shown that various tumor infiltrating T-cells express the 4-1 BB receptor and that agonistic 4-1BB antibodies trigger effective antitumor immune responses.

4-1BB ligand muteins of the invention include homo-multimers of 4-1BB ligand muteins. Each 4-1BB ligand mutein includes at least one cysteine residue substitution or insertion that promotes the formation of a disulfide bond with a cysteine residue on a neighboring 4-1BB ligand mutein. 4-1BB ligand mutein may be a transmembrane 4-1BB ligand or soluble 4-1BB ligand. Preferably, the 4-1BB ligand mutein is a soluble 4-1BB ligand lacking the transmembrane domain. In some embodiments, a disulfide bond may be formed between substituted cysteine residues on neighboring 4-1BB ligand muteins, between a substituted cysteine residue and a naturally occurring cysteine residue on neighboring 4-1BB ligand muteins, or between naturally occurring cysteine residues on neighboring 4-1BB ligand muteins. Multimers of 4-1BB ligand muteins of the invention are composed of two, three, four, or more 4-1BB ligand muteins or fragments thereof. In some embodiments, each 4-1BB ligand mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 267-296 and 731-733.

Preferably, the 4-1BB ligand mutein is a soluble 4-1BB ligand mutein that forms a 4-1BB ligand homo-multimer in which each monomer contains cysteine substitutions that replace two naturally occurring amino acid residues (i.e., non-cysteine residues) with cysteine residues or one or more cysteine insertions. In some embodiments, the 4-1BB ligand mutein contains one or more of the following cysteine substitutions: Q94C, L115C, F144C, A178C, L179C, L181C, T182C, V183C, D184C, L185C, N194C, S195C, F197C, R202C, L203C, L204C, G231C, and A232C, relative to SEQ ID NO: 267. In some embodiments, the 4-1BB ligand mutein contains one or more (preferably one) of the following pairs of cysteine substitutions: A178C/G231C, L179C/G231C, L181C/G231C, L181C/A232C, T182C/F197C, V183C/S195C, V183C/F197C, D184C/S195C, L185C/N194C, L185C/S195C, R202C/F144C, L203C/Q94C, L204C/Q94C, and L204C/L115C, relative to SEQ ID NO: 267. In other embodiments, the 4-1BB ligand mutein contains one or more cysteine substitutions or insertions (e.g., two substitutions or insertions) that are located within one or more of the following regions: amino acids 80-97, 112-118, 175-207, and 228-235, relative to the amino acid sequence of SEQ ID NO: 267 (e.g., one cysteine substitution or insertion within two different regions). The amino acid numbering is relative to the wild-type 4-1 BB ligand sequence (e.g., SEQ ID NO: 267, UniProt Accession NOs: P41273 and Q2M3S2).

Diseases and disorders that may be treated with 4-1BB ligand muteins of the invention include, but are not limited to, autoimmune disorders (e.g., those described in US Patent Publication Number US20140081011), cancers (e.g., those described in US Patent Publication Number US 20120076722), and inflammatory diseases (e.g., those described in U.S. Pat. No. 7,288,638). The contents of the referenced patent and patent publication numbers are incorporated herein by reference in their entireties. In some embodiments, 4-1BB ligand mutein of the invention may be used to activate 4-1 BB receptor expression on tumor selective T-cells and NK-cells.

In particular, 4-1BB ligand muteins of the invention may be used for the treatment of autoimmune diseases (e.g., multiple sclerosis), asthma, and GVHD.

In some embodiments, a 4-1BB ligand mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a 4-1BB ligand mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), [90]Y-Ibritumomab Tiuxetan (ZEVALIN®), and [131]I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a 4-1BB ligand cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a 4-1BB ligand mutein may be fused to a cancer antigen-specific antibody for targeted delivery of the complex and treatment of cancers expressing the cancer antigen.

OX40 Ligand (OX40L) Mutein

The ligand OX40 (OX40L) is expressed primarily on antigen presenting cells, such as DCs, B-cells, and macrophages. The therapeutic targeting of OX40L and its receptor OX40 has been pursued for cancer therapy (e.g., a cancer combination therapy with a chemotherapy agent, an immunotherapy agent, or radiation) using agonistic OX40 antibodies or recombinant forms of soluble OX40L. Patients in clinical trials using anti-OX40 treatment had an increase in tumor specific immune responses after therapy and had increased CD4+ and CD8+ T-cell proliferation. Importantly, a recombinant hexameric fusion protein of human OX40 and Fc domain had superior biological activity as soluble therapeutic in vitro compared to anti-OX40 antibody treatment.

OX40L muteins of the invention include homo-multimers of OX40L muteins. Each OX40L mutein includes at least one cysteine residue substitution or insertion that promotes the formation of a disulfide bond with a cysteine residue on a neighboring OX40L mutein. OX40L mutein may be a transmembrane OX40L or soluble OX40L. Preferably, the OX40L mutein is a soluble OX40L lacking the transmembrane domain. In some embodiments, a disulfide bond may be formed between substituted cysteine residues on neighboring OX40L muteins, between a substituted cysteine residue and a naturally occurring cysteine residue on neighboring OX40L muteins, or between naturally occurring cysteine residues on neighboring OX40L muteins. Multimers of OX40L muteins of the invention are composed of two, three, four, or more OX40L muteins or fragments thereof (e.g., a trimer). In some embodiments, each OX40L mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 112-131 and 645-647.

Preferably, the OX40L mutein is a soluble OX40L mutein that forms an OX40L homo-multimer in which each monomer contains cysteine substitutions that replace two naturally occurring amino acid residues (i.e., non-cysteine residues) with cysteine residues or one or more cysteine insertions. In some embodiments, the OX40L mutein contains one or more of the following cysteine substitutions: K63C, S104C, P125C, L126C, Q128C, L129C, K130C, S134C, M139C, V140C, A141C, N166C, and G167C, relative to SEQ ID NO: 112. In some embodiments, the OX40L mutein contains one or more (preferably one) of the following pairs of cysteine substitutions: P125C/N166C, L126C/N166C, Q128C/N166C, Q128C/G167C, L129C/S134C, K130C/S134C, M139C/S104C, V140C/K63C, and A141C/K63C, relative to SEQ ID NO: 112. In other embodiments, the OX40L mutein contains one or more cysteine substitutions or insertions (e.g., two substitutions or insertions) that are located within one or more of the following regions: amino acids 49-66, 101-107, 122-144, and 163-170, relative to the amino acid sequence of SEQ ID NO: 112 (e.g., one cysteine substitution or insertion within two different regions). The amino acid numbering is relative to the wild-type OX40L sequence (e.g., SEQ ID NO: 112, UniProt Accession NOs: P23510, Q5JZA5, and Q9HCN9).

Diseases and disorders that may be treated with OX40L muteins of the invention include, but are not limited to, inflammatory diseases (e.g., those described in US Patent Publication Number US20100136030), cancers (e.g., those described in US Patent Publication Number US20120269825 and WO2013119202), and immune diseases (e.g., those described in U.S. Pat. No. 8,551,477). The contents of the referenced patent and patent publication numbers are incorporated herein by reference in their entireties. In some embodiments, the OX40L muteins of the invention may be used in selective tumor-specific activation of OX40 signaling on T-cells.

In particular, OX40L muteins of the invention may be used for the treatment of chronic hepatitis C infection, lupus, atherosclerosis, allograft rejection, type 1 diabetes, and asthma.

In some embodiments, an OX40L mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with an OX40L mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, an OX40L cross-linking agent, a CD27 agent, a CD30 agent, a CD40 agent, a 4-1 BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, an OX40L mutein may be fused to a cancer antigen-specific antibody for targeted delivery of the complex and treatment of cancers expressing the cancer antigen.

Adiponectin Mutein

Adiponectin (also called GBP28, apM1, AdipoQ, or ACRP30) is a TNF-like ligand that is synthesized in adipose tissues and mediates metabolism and energy homeostasis. Adiponectin is a member of the complement-1q (C1q) family of proteins (also known as TNF-related family of proteins), which contain proteins that are structurally related to the TNFSF ligands. Adiponectin and other C1q family of proteins, e.g., myonectin, complement-1q tumor necrosis factor-related protein 3 (C1QTNF3), and C1QTNF5, can target receptors on muscle or liver cells.

Adiponectin muteins of the invention include homomultimers of adiponectin muteins. Each adiponectin mutein includes at least one cysteine residue substitution or insertion that promotes the formation of a disulfide bond with a cysteine residue on a neighboring adiponectin mutein. An adiponectin mutein may be a transmembrane adiponectin or soluble adiponectin. Preferably, the adiponectin mutein is a soluble adiponectin lacking the transmembrane domain. In some embodiments, a disulfide bond may be formed between substituted cysteine residues on neighboring adiponectin muteins, between a substituted cysteine residue and a naturally occurring cysteine residue on neighboring adiponectin muteins, or between naturally occurring cysteine residues on neighboring adiponectin muteins. Multimers of adiponectin muteins of the invention are composed of two, three, four, or more adiponectin muteins or fragments thereof. In some embodiments, each adiponectin mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 688-722.

Preferably, the adiponectin mutein is a soluble adiponectin mutein that forms an adiponectin homo-multimer in which each monomer contains cysteine substitutions that replace two naturally occurring amino acid residues (i.e., non-cysteine residues) with cysteine residues or one or more cysteine insertions. In some embodiments, the adiponectin mutein contains one or more of the following cysteine substitutions: S116C, A161C, A181C, M182C, L183C, F184C, T185C, Y186C, D187C, Q188C, N193C, V194C, Q196C, V201C, L202C, D229C, N230C, and D231C, relative to the amino acid sequence of SEQ ID NO: 688. In some embodiments, the adiponectin mutein contains one or more (preferably one) of the following pairs of cysteine substitutions: A181C/D229C, A181C/N230C, M182C/D229C, M182C/N230C, L183C/D229C, F184C/D229C, F184C/N230C, F184C/D231C, T185C/Q196C, Y186C/V194C, Y186C/Q196C, D187C/V194C, Q188C/N193C, Q188C/V194C, V201C/A161C, and L202C/S116C, relative to SEQ ID NO: 688. In other embodiments, the adiponectin mutein contains one or more cysteine substitutions or insertions (e.g., two substitutions or insertions) that are located within one or more of the following regions: amino acids 103-119, 158-164, 178-205, and 226-234, relative to the amino acid sequence of SEQ ID NO: 688 (e.g., one cysteine substitution or insertion within two different regions). The amino acid numbering is relative to the wild-type adiponectin sequence (e.g., SEQ ID NO: 688, UniProt Accession NOs: Q15848).

Diseases and disorders that may be treated with adiponectin muteins of the invention include, but are not limited to, metabolic diseases (e.g., those described in US Patent Application Publication Number US 20020132773 and US 20100273708) and pulmonary diseases (e.g., those described in US Patent Application Publication Number US 20110218146). The contents of the above-referenced patent publications are incorporated herein by reference in their entireties.

In particular, adiponectin muteins of the invention may be used for the treatment of metabolic syndrome, type 2 diabetes, and atherosclerosis.

In some embodiments, an adiponectin mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with an adiponectin mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, an adiponectin cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, an adiponectin mutein may be fused to a cancer antigen-specific antibody for targeted delivery of the complex and treatment of cancers expressing the cancer antigen.

LT-α Mutein

LT-α muteins of the invention include homo-multimers of LT-α muteins. Each LT-α mutein includes at least one cysteine residue substitution or insertion that promotes the formation of a disulfide bond with a cysteine residue on a neighboring LT-α mutein. LT-α mutein may be a transmembrane LT-α or soluble LT-α. Preferably, the LT-α mutein is a soluble LT-α lacking the transmembrane domain. In some embodiments, a disulfide bond may be formed between substituted cysteine residues on neighboring LT-α muteins, between a substituted cysteine residue and a naturally occurring cysteine residue on neighboring LT-α muteins, or between naturally occurring cysteine residues on neighboring LT-α muteins. Multimers of LT-α muteins of the invention are composed of two, three, four, or more LT-α muteins or fragments thereof. In some embodiments, each LT-α mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 40-75.

Preferably, the LT-α mutein is a soluble LT-α mutein that forms an LT-α homo-multimer in which each monomer contains cysteine substitutions that replace two naturally occurring amino acid residues (i.e., non-cysteine residues) with cysteine residues or one or more cysteine insertions. In some embodiments, the LT-α mutein contains one or more of the following cysteine substitutions: H66C, R85C, Y110C, P147C, L148C L149C, S150C, S151C, Q152C, K153C, M154C, W163C, L164C, S166C, A171C, A172C, F173C, P195C, S196C, and T197C, relative to SEQ ID NO: 40. In some embodiments, the LT-α mutein contains one or more (preferably one) of the following pairs of cysteine substitutions: P147C/P195C, P147C/S196C, L148C/P195C, L148C/S196C, L149C/P195C, S150C/S196C, S150C/P195C, S150C/T197C, S151C/S166C, Q152C/L164C, Q152C/S166C, K153C/L164C, M154C/W163C, M154C/L164C, A171C/Y110C, A172C/H66C, F173C/H66C, and F173C/R85C, relative to SEQ ID NO: 40. In other embodiments, the LT-α mutein contains one or more cysteine substitutions or insertions (e.g., two substitutions or insertions) that are located within one or more of the following regions: amino acids 52-69, 82-88, 107-113, 144-176, and 192-200, relative to the amino acid sequence of SEQ ID NO: 40 (e.g., one cysteine substitution or insertion within two different regions). The amino acid numbering is relative to the wild-type LT-α sequence (e.g., SEQ ID NO: 40, UniProt Accession NOs: P01374, Q8N4C3, and Q9UKS8).

LT-α muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, LT-α muteins of the invention may be used for the treatment of T cell lymphoma, vitiligo, non-Hodgkin's lymphoma, psoriatic arthritis, and leprosy.

In some embodiments, a LT-α mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a LT-α mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a LT-α cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a LT-α mutein may be fused to a cancer antigen-specific antibody for targeted delivery of the complex and treatment of cancers expressing the cancer antigen.

LT-β Mutein

LT-β muteins of the invention include homo-multimers of LT-β muteins. Each LT-β mutein includes at least one cysteine residue substitution or insertion that promotes the formation of a disulfide bond with a cysteine residue on a neighboring LT-β mutein. LT-β mutein may be a transmembrane LT-β or soluble LT-13. Preferably, the LT-β mutein is a soluble LT-β lacking the transmembrane domain. In some embodiments, a disulfide bond may be formed between substituted cysteine residues on neighboring LT-β muteins, between a substituted cysteine residue and a naturally occurring cysteine residue on neighboring LT-β muteins, or between naturally occurring cysteine residues on neighboring LT-β muteins. Multimers of LT-β muteins of the invention are composed of two, three, four, or more LT-3 muteins or fragments thereof. In some embodiments, each LT-β mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 76-111.

Preferably, the LT-β mutein is a soluble LT-43 mutein that forms an LT-β homo-multimer in which each monomer contains cysteine substitutions that replace two naturally occurring amino acid residues (i.e., non-cysteine residues) with cysteine residues or one or more cysteine insertions. In some embodiments, the LT-β mutein contains one or more of the following cysteine substitutions: H91C, O110C, Y136C, L177C, L178C, L179C, E180C, G181C, A182C, E183C, T184C, W201C, Y202C, S204C, G209C, L210C, V211C, R233C, G234C, and K235C, relative to SEQ ID NO: 76. In some embodiments, the LT-β mutein contains one or more (preferably one) of the following pairs of cysteine substitutions: L177C/R233C, L177C/G234C, L178C/R233C, L178C/G234C, L179C/R233C, E180C/R233C, E180C/G234C, E180C/K235C, G181C/S204C, A182C/Y202C, A182C/S204C, E183C/Y202C, T184C/W201C, T184C/Y202C, G209C/Y136C, L210C/H91C, V211C/H91C, and V211C/Q110C, relative to SEQ ID NO: 76. In other embodiments, the LT-β mutein contains one or more cysteine substitutions or insertions (e.g., two substitutions or insertions) that are located within one or more of the following regions: amino acids 77-94, 107-113, 133-139, 174-187, 199-214, and 230-238, relative to the amino acid sequence of SEQ ID NO: 76 (e.g., one cysteine substitution or insertion within two different regions). The amino acid numbering is relative to the wild-type LT-β sequence (e.g., SEQ ID NO: 76, UniProt Accession NOs: Q06643, P78370, Q52LU8, and O99761).

LT-β muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, LT-β muteins of the invention may be used for the treatment of type 1 diabetes, rheumatoid arthritis, and cancer (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma).

In some embodiments, a LT-β mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a LT-β mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a LT-β cross-linking agent, a CD27 agent, a CD30 agent, a CD40 agent, a 4-1 BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a LT-β mutein may be fused to a cancer antigen-specific antibody for targeted delivery of the complex and treatment of cancers expressing the cancer antigen.

CD153 Mutein

CD153 muteins of the invention include homo-multimers of CD153 muteins. Each CD153 mutein includes at least one cysteine residue substitution or insertion that promotes the formation of a disulfide bond with a cysteine residue on a neighboring CD153 mutein. CD153 mutein may be a transmembrane CD153 or soluble CD153. Preferably, the CD153 mutein is a soluble CD153 lacking the transmembrane domain. In some embodiments, a disulfide bond may be formed between substituted cysteine residues on neighboring CD153 muteins, between a substituted cysteine residue and a naturally occurring cysteine residue on neighboring CD153 muteins, or between naturally occurring cysteine residues on neighboring CD153 muteins. Multimers of CD153 muteins of the invention are composed of two, three, four, or more CD153 muteins or fragments thereof. In some embodiments, each CD153 mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 236-266.

Preferably, the CD153 mutein is a soluble CD153 mutein that forms an CD153 homo-multimer in which each monomer contains cysteine substitutions that replace two naturally occurring amino acid residues (i.e., non-cysteine residues) with cysteine residues or one or more cysteine insertions. In some embodiments, the CD153 mutein contains one or more of the following cysteine substitutions: Y101C, I142C, C151S, A172C, L173C, V174C, T175C, V176C, E178C, S179C, V186C, Y187C, N189C, L194C, L195C, D196C, P220C, L221C, and E222C, relative to SEQ ID NO: 236. In some embodiments, the CD153 mutein contains one or more (preferably one) of the following pairs of cysteine substitutions: A172C/P220C, A172C/L221C, L173C/P220C, L173C/L221C, V174C/P220C, T175C/P220C, T175C/L221C, T175C/E222C, V176C/N189C, E178C/Y187C, S179C/V186C, S179C/Y187C, Y187C/C151S, N189C/C151S, L194C/I142C, L195C/Y101C, and D196C/Y101C, relative to SEQ ID NO: 236. In other embodiments, the CD153 mutein contains one or more cysteine substitutions or insertions (e.g., two substitutions or insertions) that are located within one or more of the following regions: amino acids 86-104, 169-199, and 217-225, relative to the amino acid sequence of SEQ ID NO: 236 (e.g., one cysteine substitution or insertion within two different regions). The amino acid numbering is relative to the wild-type CD153 sequence (e.g., SEQ ID NO: 236, UniProt Accession NOs: P32971 and O43404).

CD153 muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, CD153 muteins of the invention may be used for the treatment of atherosclerosis, rheumatoid arthritis, ovarian cancer, tuberculosis (TB), asthma, and GVHD.

In some embodiments, a CD153 mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a CD153 mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a CD153 cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody;

immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a CD153 mutein may be fused to a cancer antigen-specific antibody for targeted delivery of the complex and treatment of cancers expressing the cancer antigen.

RANKL Mutein

RANKL muteins of the invention include homo-multimers of RANKL muteins. Each RANKL mutein includes at least one cysteine residue substitution or insertion that promotes the formation of a disulfide bond with a cysteine residue on a neighboring RANKL mutein. RANKL mutein may be a transmembrane RANKL or soluble RANKL. Preferably, the RANKL mutein is a soluble RANKL lacking the transmembrane domain. In some embodiments, a disulfide bond may be formed between substituted cysteine residues on neighboring RANKL muteins, between a substituted cysteine residue and a naturally occurring cysteine residue on neighboring RANKL muteins, or between naturally occurring cysteine residues on neighboring RANKL muteins. Multimers of RANKL muteins of the invention are composed of two, three, four, or more RANKL muteins or fragments thereof. In some embodiments, each RANKL mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 333-368 and 622.

Preferably, the RANKL mutein is a soluble RANKL mutein that forms a RANKL homo-multimer in which each monomer contains cysteine substitutions that replace two naturally occurring amino acid residues (i.e., non-cysteine residues) with cysteine residues or one or more cysteine insertions. In some embodiments, the RANKL mutein contains one or more of the following cysteine substitutions: H167C, W193C, Y217C, T254C, L255C, M256C, K257C, G258C, G259C, S260C, W264C, G266C, H271C, F272C, S274C, G279C, F280C, F281C, Q303C, D304C, and A305C, relative to SEQ ID NO: 333. In some embodiments, the RANKL mutein contains one or more (preferably one) of the following pairs of cysteine substitutions: T254C/Q303C, T254C/D304C, L255C/Q303C, L255C/D304C, M256C/Q303C, K257C/Q303C, K257C/D304C, K257C/A305C, G258C/S274C, G259C/F272C, G259C/S274C, S260C/H271C, S260C/F272C, W264C/G266C, G279C/Y217C, F280C/H167C, F281C/H167C, and F281C/W193C, relative to SEQ ID NO: 333. In other embodiments, the RANKL mutein contains one or more cysteine substitutions or insertions (e.g., two substitutions or insertions) that are located within one or more of the following regions: amino acids 153-170, 190-196, 214-220, 251-284, and 300-308, relative to the amino acid sequence of SEQ ID NO: 333 (e.g., one cysteine substitution or insertion within two different regions). The amino acid numbering is relative to the wild-type RANKL sequence (e.g., SEQ ID NO: 333, UniProt Accession NOs: O14788, O14723, Q96, Q17, and Q9P2Q3).

RANKL muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, RANKL muteins of the invention may be used for the treatment of diseases related to bone loss, periodontal disease, hypercalcemia, pain, complications related to transplantations (e.g., cell, tissue, and organ), cancer (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, autoimmune diseases, and those diseases and disorders described in Hofbauer et al. (Cancer 92:460-470, 2001), Suda et al. (Endocr Rev. 20:345-357, 1999), and U.S. Pat. No. 7,399,829, each of which is incorporated herein by reference in its entirety.

In some embodiments, an RANKL mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with an RANKL mutein described herein include Trastuzamb (HERCEPTIN®), Bevacizumab (AVASTIN®) Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, an RANKL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, an RANKL mutein may be fused to a cancer antigen-specific antibody for targeted delivery of the complex and treatment of cancers expressing the cancer antigen.

TWEAK Mutein

TWEAK muteins of the invention include homo-multimers of TWEAK muteins. Each TWEAK mutein includes at least one cysteine residue substitution or insertion that promotes the formation of a disulfide bond with a cysteine residue on a neighboring TWEAK mutein. TWEAK mutein may be a transmembrane TWEAK or soluble TWEAK. Preferably, the TWEAK mutein is a soluble TWEAK lacking the transmembrane domain. In some embodiments, a disulfide bond may be formed between substituted cysteine residues on neighboring TWEAK muteins, between a substituted cysteine residue and a naturally occurring cysteine residue on neighboring TWEAK muteins, or between naturally occurring cysteine residues on neighboring TWEAK muteins. Multimers of TWEAK muteins of the invention are composed of two, three, four, or more TWEAK muteins or fragments thereof. In some embodiments, each TWEAK mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 369-397.

Preferably, the TWEAK mutein is a soluble TWEAK mutein that forms a TWEAK homo-multimer in which each monomer contains cysteine substitutions that replace two naturally occurring amino acid residues (i.e., non-cysteine residues) with cysteine residues or one or more cysteine insertions. In some embodiments, the TWEAK mutein contains one or more of the following cysteine substitutions: Y164C, L187C, A188C, L189C, R190C, L192C, E193C, E194C, Q206C, L207C, L209C, R208C, S213C, G214C, P238C, F239C, and L240C, relative to SEQ ID NO: 369. In some embodiments, the TWEAK mutein contains one or more (preferably one) of the following pairs of cysteine substitutions: Y164C/S213C, Y164C/G214C, L187C/P238C, L187C/F239C, A188C/P238C, A188C/F239C, L189C/P238C, R190C/P238C, R190C/F239C, R190C/L240C, L192C/L207C, L192C/L209C, E193C/R208C, E194C/Q206C, and E194C/L207C, relative to SEQ ID NO: 369. In other embodiments, the TWEAK mutein contains one or more cysteine substitutions or insertions (e.g., two substitutions or insertions) that are located within one or more of the following regions: amino acids 96-105, 161-167, 184-197, 204-217, and 235-243, relative to the amino acid sequence of SEQ ID NO: 369 (e.g., one cysteine substitution or insertion within two different regions). The amino acid numbering is relative to the wild-type TWEAK sequence (e.g., SEQ ID NO: 369, UniProt Accession NOs: O43508, Q8IZK7, and Q8WUZ7).

TWEAK muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, TWEAK muteins of the invention may be used in tissue repair and remodeling.

In some embodiments, a TWEAK mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesciomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a TWEAK mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TWEAK cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a TWEAK mutein may be fused to a cancer antigen-specific antibody for targeted delivery of the complex and treatment of cancers expressing the cancer antigen.

APRIL Mutein

APRIL muteins of the invention include homo-multimers of APRIL muteins. Each APRIL mutein includes at least one cysteine residue substitution or insertion that promotes the formation of a disulfide bond with a cysteine residue on a neighboring APRIL mutein. APRIL mutein may be a transmembrane APRIL or soluble APRIL. Preferably, the APRIL mutein is a soluble APRIL lacking the transmembrane domain. In some embodiments, a disulfide bond may be formed between substituted cysteine residues on neighboring APRIL muteins, between a substituted cysteine residue and a naturally occurring cysteine residue on neighboring APRIL muteins, or between naturally occurring cysteine residues on neighboring APRIL muteins. Multimers of APRIL muteins of the invention are composed of two, three, four, or more APRIL muteins or fragments thereof. In some embodiments, each APRIL mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 398-434.

Preferably, the APRIL mutein is a soluble APRIL mutein that forms a APRIL homo-multimer in which each monomer contains cysteine substitutions that replace two naturally occurring amino acid residues (i.e., non-cysteine residues) with cysteine residues or one or more cysteine insertions. In some embodiments, the APRIL mutein contains one or more of the following cysteine substitutions: H119C, F127C, A141C, Y166C, T192C, L193C, F194C, R195C, I197C, R198C, S199C, A207C, Y208C, S210C, C211S, G215C, V216C, F217C, P240C, H241C, and G242C, relative to SEQ ID NO: 398. In some embodiments, the APRIL mutein contains one or more (preferably one) of the following pairs of cysteine substitutions: T192C/P240C, T192C/H241C, L193C/P240C, L193C/H241C, F194C/P240C, R195C/P240C, R195C/H241C, R195C/G242C, I197C/Y208C, I197C/S210C, R198C/Y208C, S199C/A207C, S199C/Y208C, S210C/C211S, G215C/Y166C, V216C/H119C, F217C/H119C, and F127C/A141C, relative to SEQ ID NO: 398. In other embodiments, the APRIL mutein contains one or more cysteine substitutions or insertions (e.g., two substitutions or insertions) that are located within one or more of the following regions: amino acids 105-130, 138-144, 163-169, 189-220, and 237-245, relative to the amino acid sequence of SEQ ID NO: 398 (e.g., one cysteine substitution or insertion within two different regions). The amino acid numbering is relative to the wild-type APRIL sequence (e.g., SEQ ID NO: 398, UniProt Accession NOs: O75888, A8MYD5, B4DVT2, Q541E1, Q5U0G8, Q96HV6, Q9P1M8, and Q9P1M9).

APRIL muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, APRIL muteins of the invention may be used to induce and stimulate B cell maturation and reconstitution.

In some embodiments, an APRIL mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with an APRIL mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, an APRIL cross-linking agent, a CD27 agent, a CD30 agent, a CD40 agent, a 4-1 BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, an APRIL mutein may be fused to a cancer antigen-specific antibody for targeted delivery of the complex and treatment of cancers expressing the cancer antigen.

BLys Mutein

BLys muteins of the invention include homo-multimers of BLys muteins. Each BLys mutein includes at least one cysteine residue substitution or insertion that promotes the formation of a disulfide bond with a cysteine residue on a neighboring BLys mutein. BLys mutein may be a transmembrane BLys or soluble BLys. Preferably, the BLys mutein is a soluble BLys lacking the transmembrane domain. In some embodiments, a disulfide bond may be formed between substituted cysteine residues on neighboring BLys muteins, between a substituted cysteine residue and a naturally occurring cysteine residue on neighboring BLys muteins, or between naturally occurring cysteine residues on neighboring BLys muteins. Multimers of BLys muteins of the invention are composed of two, three, four, or more BLys muteins or fragments thereof. In some embodiments, each BLys mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 435-466.

Preferably, the BLys mutein is a soluble BLys mutein that forms a BLys homo-multimer in which each monomer contains cysteine substitutions that replace two naturally occurring amino acid residues (i.e., non-cysteine residues) with cysteine residues or one or more cysteine insertions. In some embodiments, the BLys mutein contains one or more of the following cysteine substitutions: Q148C, Y196C, T228C, L229C, F230C, R231C, I233C, Q234C, N235C, P241C, N242C, S244C, G249C, I250C, A251C, G274C, D275C, and V276C, relative to SEQ ID NO: 435. In some embodiments, the BLys mutein contains one or more (preferably one) of the following pairs of cysteine substitutions: T228C/G274C, T228C/D275C, L229C/G274C, L229C/D275C, F230C/G274C, R231C/G274C, R231C/D275C, R231C/V276C, I233C/N242C, I233C/S244C, Q234C/N242C, N235C/P241C, N235C/N242C, G249C/Y196C, I250C/Q148C, and A251C/Q148C, relative to SEQ ID NO: 435. In other embodiments, the BLys mutein contains one or more cysteine substitutions or insertions (e.g., two substitutions or insertions) that are located within one or more of the following regions: amino acids 134-151, 225-254, and 271-279, relative to the amino acid sequence of SEQ ID NO: 435 (e.g., one cysteine substitution or insertion within two different regions). The amino acid numbering is relative to the wild-type BLys sequence (e.g., SEQ ID NO: 435, UniProt Accession NOs: Q9Y275, E0ADT7, Q6FHD6, and Q7Z5J2).

BLys muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, BLys muteins of the invention may be used to induce and stimulate B cell maturation and reconstitution.

In some embodiments, a BLys mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a BLys mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a BLys cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a BLys mutein may be fused to a cancer antigen-specific antibody for targeted delivery of the complex and treatment of cancers expressing the cancer antigen.

LIGHT Mutein

LIGHT muteins of the invention include homo-multimers of LIGHT muteins. Each LIGHT mutein includes at least one cysteine residue substitution or insertion that promotes the formation of a disulfide bond with a cysteine residue on a neighboring LIGHT mutein. LIGHT mutein may be a transmembrane LIGHT or soluble LIGHT. Preferably, the LIGHT mutein is a soluble LIGHT lacking the transmembrane domain. In some embodiments, a disulfide bond may be formed between substituted cysteine residues on neighboring LIGHT muteins, between a substituted cysteine residue and a naturally occurring cysteine residue on neighboring LIGHT muteins, or between naturally occurring cysteine residues on neighboring LIGHT muteins. Multimers of LIGHT muteins of the invention are composed of two, three, four, or more LIGHT muteins or fragments thereof. In some embodiments, each LIGHT mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 467-505.

Preferably, the LIGHT mutein is a soluble LIGHT mutein that forms a LIGHT homo-multimer in which each monomer contains cysteine substitutions that replace two naturally occurring amino acid residues (i.e., non-cysteine residues) with cysteine residues or one or more cysteine insertions. In some embodiments, the LIGHT mutein contains one or more of the following cysteine substitutions: H97C, L120C, Y144C, E178C, L179C, L180C, V181C, S182C, Q183C, O184C, S185C, G188C, T191C, W197C, W198C, S200C, G205C, V206C, V207C, G230C, T231C, and R232C, relative to SEQ ID NO: 467. In some embodiments, the LIGHT mutein contains one or more (preferably one) of the following pairs of cysteine substitutions: E178C/G230C, E178C/T231C, L179C/G230C, L179C/T231C, L180C/G230C, V181C/G230C, V181C/T231C, V181C/R232C, S182C/S200C, Q183C/W198C, Q183C/S200C, Q184C/W198C, S185C/W197C, S185C/W198C, G188C/T191C, G205C/Y144C, V206C/H97C, V207C/H97C, and V207C/L120C, relative to SEQ ID NO: 467. In other embodiments, the LIGHT mutein contains one or more cysteine substitutions or insertions (e.g., two substitutions or insertions) that are located within one or more of the following regions: amino acids 83-100, 117-123, 175-210, and 227-235, relative to the amino acid sequence of SEQ ID NO: 467 (e.g., one cysteine substitution or insertion within two different regions). The amino acid numbering is relative to the wild-type LIGHT sequence (e.g., SEQ ID NO: 467, UniProt Accession NOs: 043557, A8K7M2, C9J5H4, 075476, Q6FHA1, Q8WVF8, and Q96LD2).

LIGHT muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, LIGHT muteins of the invention may be used for the treatment of cancer, such as solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma.

In some embodiments, a LIGHT mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a LIGHT mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a LIGHT cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a LIGHT mutein may be fused to a cancer antigen-specific antibody for targeted delivery of the complex and treatment of cancers expressing the cancer antigen.

TL1 Mutein

TL1 muteins of the invention include homo-multimers of TL1 muteins. Each TL1 mutein includes at least one cysteine residue substitution or insertion that promotes the formation of a disulfide bond with a cysteine residue on a neighboring TL1 mutein. TL1 mutein may be a transmembrane TL1 or soluble TL1. Preferably, the TL1 mutein is a soluble TL1 lacking the transmembrane domain. In some embodiments, a disulfide bond may be formed between substituted cysteine residues on neighboring TL1 muteins, between a substituted cysteine residue and a naturally occurring cysteine residue on neighboring TL1 muteins, or between naturally occurring cysteine residues on neighboring TL1 muteins. Multimers of TL1 muteins of the invention are composed of two, three, four, or more TL1 muteins or fragments thereof. In some embodiments, each TL1 mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 506-541.

Preferably, the TL1 mutein is a soluble TL1 mutein that forms a TL1 homo-multimer in which each monomer contains cysteine substitutions that replace two naturally occurring amino acid residues (i.e., non-cysteine residues) with cysteine residues or one or more cysteine insertions. In some embodiments, the TL1 mutein contains one or more of the following cysteine substitutions: H98C, L125C, Y150C, Q193C, L194C, L195C, M196C, G197C, T198C, K199C, S200C, W208C, F209C, P211C, A216C, M217C, F218C, E241C, D242O, and K243C, relative to SEQ ID NO: 506. In some embodiments, the TL1 mutein contains one or more (preferably one) of the following pairs of cysteine substitutions: Q193C/E241C, Q193C/D242C, L194C/E241C, L194C/D242C, L195C/E241C, M196C/E241C, M196C/D242C, M196C/K243C, G197C/P211C, T198C/F209C, T198C/P211C, K199C/F209C, S200C/W208C, S200C/F209C, A216C/Y150C, M217C/H98C, F218C/H98C, and F218C/L125C, relative to SEQ ID NO: 506. In other embodiments, the TL1 mutein contains one or more cysteine substitutions or insertions (e.g., two substitutions or insertions) that are located within one or more of the following regions: amino acids 84-101, 122-128, 190-221, and 238-246, relative to the amino acid sequence of SEQ ID NO: 506 (e.g., one cysteine substitution or insertion within two different regions). The amino acid numbering is relative to the wild-type TL1 sequence (e.g., SEQ ID NO: 506, UniProt Accession NOs: O95150, Q3SX69, Q5VJK8, Q5VWH1, and Q8NFE9).

TL1 muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, TL1 muteins of the invention may be used for the treatment of cancer, such as solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma.

In some embodiments, a TL1 mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a TL1 mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TL1 cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a TL1 mutein may be fused to a cancer antigen-specific antibody for targeted delivery of the complex and treatment of cancers expressing the cancer antigen.

GITRL Mutein

GITRL (also called TL6) muteins of the invention include homo-multimers of GITRL muteins. Each GITRL mutein includes at least one cysteine residue substitution or insertion that promotes the formation of a disulfide bond with a cysteine residue on a neighboring GITRL mutein. GITRL mutein may be a transmembrane GITRL or soluble GITRL.

Preferably, the GITRL mutein is a soluble GITRL lacking the transmembrane domain. In some embodiments, a disulfide bond may be formed between substituted cysteine residues on neighboring GITRL muteins, between a substituted cysteine residue and a naturally occurring cysteine residue on neighboring GITRL muteins, or between naturally occurring cysteine residues on neighboring GITRL muteins. Multimers of GITRL muteins of the invention are composed of two, three, four, or more GITRL muteins or fragments thereof. In some embodiments, each GITRL mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 542-561.

Preferably, the GITRL mutein is a soluble GITRL mutein that forms a GITRL homo-multimer in which each monomer contains cysteine substitutions that replace two naturally occurring amino acid residues (i.e., non-cysteine residues) with cysteine residues or one or more cysteine insertions. In some embodiments, the GITRL mutein contains one or more of the following cysteine substitutions: K83C, Y120C, T148C, L149C, N184C, T150C, N151C, K152C, S153C, I155C, G160C, T161C, and Y162C, relative to SEQ ID NO: 542. In some embodiments, the GITRL mutein contains one or more (preferably one) of the following pairs of cysteine substitutions: T148C/N184C, L149C/I155C, T150C/S153C, T150C/I155C, N151C/S153C, K152C/S153C, G160C/Y120C, T161C/K83C, and Y162C/K83C, relative to SEQ ID NO: 542. In other embodiments, the GITRL mutein contains one or more cysteine substitutions or insertions (e.g., two substitutions or insertions) that are located within one or more of the following regions: amino acids 69-86, 117-123, 145-165, 181-187, and 269-277, relative to the amino acid sequence of SEQ ID NO: 542 (e.g., one cysteine substitution or insertion within two different regions). The amino acid numbering is relative to the wild-type GITRL sequence (e.g., SEQ ID NO: 542, UniProt Accession NOs: Q9UNG2, A91QG8, O95852, and Q6ISV1).

GITRL muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, GITRL muteins of the invention may be used for the treatment of cancer, such as solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma.

In some embodiments, a GITRL mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with a GITRL mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a GITRL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, a GITRL mutein may be fused to a cancer antigen-specific antibody for targeted delivery of the complex and treatment of cancers expressing the cancer antigen.

EDA Mutein

EDA (e.g., EDA-A1 and EDA-A2) muteins of the invention include homo-multimers of EDA muteins. Each EDA mutein includes at least one cysteine residue substitution or insertion that promotes the formation of a disulfide bond with a cysteine residue on a neighboring EDA mutein. EDA mutein may be a transmembrane EDA or soluble EDA. Preferably, the EDA mutein is a soluble EDA lacking the transmembrane domain. In some embodiments, a disulfide bond may be formed between substituted cysteine residues on neighboring EDA muteins, between a substituted cysteine residue and a naturally occurring cysteine residue on neighboring EDA muteins, or between naturally occurring cysteine residues on neighboring EDA muteins. Multimers of EDA muteins of the invention are composed of two, three, four, or more EDA muteins or fragments thereof. In some embodiments, each EDA mutein or fragment thereof has at least 50% sequence identity (e.g., 50%, 55%, 60%, 65%, 70%, 75%, 80%, 85%, 90%, 95%, 99%, or 100%) to a sequence selected from any one of SEQ ID NOs: 562-589.

Preferably, the EDA mutein is a soluble EDA mutein that forms a EDA homo-multimer in which each monomer contains cysteine substitutions that replace two naturally occurring amino acid residues (i.e., non-cysteine residues) with cysteine residues or one or more cysteine insertions. In some embodiments, the EDA mutein contains one or more of the following cysteine substitutions: V250C, H252C, T278C, Y304C, P328C, F329C, L330C, Q331C, T333C, R334C, S335C, N342C, Y343C, T345C, G350C, V351C, H376C, and T377C, relative to SEQ ID NO: 562. In some embodiments, the EDA mutein contains one or more (preferably one) of the following pairs of cysteine substitutions: P328C/H376C 577, F329C/H376C, L330C/H376C, L330C/T377C, Q331C/H376C, Q331C/T377C, T333C/Y343C, T333C/T345C, R334C/Y343C, S335C/N342C, S335C/Y343C, G350C/Y304C, V351C/V250C, and V351C/H252C, relative to SEQ ID NO: 562. In other embodiments, the EDA mutein contains one or more cysteine substitutions or insertions (e.g., two substitutions or insertions) that are located within one or more of the following regions: amino acids 238-255, 275-281, 301-307, 325-354, and 373-380, relative to the amino acid sequence of SEQ ID NO: 562 (e.g., one cysteine substitution or insertion within two different regions). The amino acid numbering is relative to the wild-type EDA sequence (e.g., SEQ ID NO: 562, UniProt Accession NOs: Q92838, A0AUZ2, A2A337, B7ZLU2, B7ZLU4, O75910, Q5JS00, Q5JUM7, Q9UP77, Q9Y6L0, Q9Y6L1, Q9Y6L2, Q9Y6L3, and Q9Y6L4).

EDA muteins of the invention may be used for the treatment of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

In particular, EDA muteins of the invention may be used for the treatment of cancer, such as solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma.

In some embodiments, an EDA mutein may be used to treat various cancers alone or in a combination therapy with a chemotherapy agent, an immunotherapy agent, or radiation. Chemotherapy agents used in a combination therapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents that may be used in combination with an EDA mutein described herein include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al. Additional examples of chemotherapy agents are described herein (see section: Methods of Treatment Using Covalently Cross-linked Multimers of TNFSF or TNF-Like Ligand Muteins).

Immunotherapy agents used in a combination therapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, an EDA cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, radiation includes the use of directed gamma rays or beta rays to induce sufficient damage to a cell so as to limit its ability to function normally or to destroy the cell altogether.

In some other embodiments, an EDA mutein may be fused to a cancer antigen-specific antibody for targeted delivery of the complex and treatment of cancers expressing the cancer antigen.

The above examples describe a few TNFSF and TNF-like ligand muteins and their signaling mechanisms and therapeutic roles in various types of diseases to which the TNFSF and TNF-like ligand muteins may be employed. TNFSF and TNF-like ligand muteins of the invention form stable, cross-linked (i.e., disulfide bonded) multimers of TNFSF or TNF-like ligands that have improved half-life and signaling activities. TNFSF and TNF-like ligand muteins of the invention (as homo-multimeric complexes, such as homo-trimers) may be used in pharmaceutical compositions or any therapeutic methods for treatments of autoimmune diseases, neurological diseases, cancers (e.g., solid tumor cancer, hematopoietic cancer, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoporosis), allergies, blood disorders (e.g., hemophilia), AIDS, musculoskeletal disorders, diseases related to growth receptors, obesity, for tissue or organ repair or regeneration, and for use in organ transplantation procedures (e.g., to treat or reduce complications resulting from organ transplantation (e.g., graft-versus-host disease (GVHD) and graft rejection)).

Covalent Cross-Linking of TNFSF and TNF-Like Ligand Muteins

Stable multimers of TNFSF or TNF-like ligands (e.g., stable homo-trimers) may be formed by introducing one or more cysteine residues to the region(s) at the interface between the TNFSF or TNF-like ligand monomers (e.g., exterior-facing residues). The cysteine residues can be disulfide bonded to each other to form the cross-linked (e.g., disulfide bonded) TNFSF or TNF-like ligand mutein multimers. Multimers of TNFSF or TNF-like ligand muteins of the invention are composed of two, three, four, or more TNFSF or TNF-like ligand muteins or fragments thereof (preferably three muteins).

In general, TNFSF or TNF-like ligand muteins of the invention may be formed by substituting at least one amino acid of a TNFSF or TNF-like ligand with a cysteine residue and/or by inserting one or more cysteine residues to form the TNFSF or TNF-like ligand mutein. In addition to those residues and regions disclosed herein, available crystal structures of TNFSF and TNF-like ligands may aid in choosing which other amino acid residue(s) can be substituted with a cysteine or identifying additional amino acid regions to insert one or more cysteine residues. Preferably, the amino acid substitution is a conservative substitution. The introduced cysteine residue(s) on the TNFSF or TNF-like ligand mutein is preferably located at the interface between the TNFSF or TNF-like ligand monomers (i.e., exterior-facing residues). The cysteine residues on neighboring TNFSF or TNF-like ligand muteins are preferably located in close proximity to each other to allow disulfide bond formation. The amino acid(s) chosen for cysteine substitution are preferably not involved in ligand/receptor interactions. Also, the chosen amino acid(s) preferably do not undergo any dramatic structural change from free to receptor-bound states, such that the ideal distance to form disulfide bond is maintained. Available crystal structures of TNFSF and TNF-like ligands can serve to guide the choice of cysteine substitutions and regions to insert cysteine residues. Table 1 lists singles and pairs of exemplary cysteine substitutions for each TNFSF or TNF-like ligand mutein. Table 2 lists amino acid regions into which a cysteine residue may be substituted and/or inserted in each TNFSF or TNF-like ligand mutein (e.g., one cysteine substitution or insertion within two different regions). As an example, the TNF-α mutein contains one or more cysteine substitutions or insertions (e.g., two substitutions or insertions) that are located within one or more of the following regions: amino acids 77-94, 107-113, 127-138, 165-204, and 220-228, relative to the amino acid sequence of SEQ ID NO: 1 (e.g., one cysteine substitution or insertion within two different regions).

TABLE 1

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| TNF-α (Gene names: | P01375 (SEQ ID NO: 1), | R82C; T83C; T84C; T85C; H91C; N110C; G130C; L131C; Y135C; | L131C/T83C; L131C/P84C; G130C/S85C; | 1TNF, chain A | R6C; T7C; P8C; S9C; H15C; N34C; G54C; L55C; Y59C; N92C; | G54C/S9C; L55C/P8C; L55C/T7C; |

TABLE 1-continued

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| TNF, TNFA, TNFSF2 | O43647, Q9P1Q2, Q9UIV3 | N168C; L169C; L170C; S171C; A172C; I173C; K174C; S175C; Q178C; E180C; W190C; Y191C; P193C; G198C; V199C; F200C; Q201C; S223C; G224C; Q225C | S171C/G224C; N168C/S223C; N168C/G224C; L169C/S223C; L169C/G224C; L170C/S223C; S171C/S223C; S171C/Q225C; A172C/P193C; I173C/Y191C; I173C/P193C; K174C/Y191C; S175C/W190C; S175C/Y191C; Q178C/E180C; G198C/Y135C; V199C/H91C; F200C/H91C; F200C/N110C; Q201C/R82C; Q201C/T83C |  | L93C; L94C; S95C; A96C; I97C; K98C; S99C; Q102C; E104C; W114C; Y115C; P117C; G122C; V123C; F124C; Q125C; S147C; G148C; Q149C | S95C/G148C; N92C/S147C; N92C/G148C; L93C/S147C; L93C/G148C; L94C/S147C; S95C/S147C; S95C/Q149C; A96C/P117C; I97C/Y115C; I97C/P117C; K98C/Y115C; S99C/W114C; S99C/Y115C; Q102C/E104C; G122C/Y59C; V123C/H15C; F124C/H15C; F124C/N34C; Q125C/R6C |
| LT-α (Gene names: LTA, TNFB, TNFSF1) | P01374 (SEQ ID NO: 40), Q8N4C3, Q9UKS8 | H66C; R85C; Y110C; P147C; L148C L149C; S150C; S151C; Q152C; K153C; M154C; W163C; L164C; S166C; A171C; A172C; F173C; P195C; S196C; T197C | P147C/P195C; P147C/S196C; L148C/P195C; L148C/S196C; L149C/P195C; S150C/S196C; S150C/P195C; S150C/T197C; S151C/S166C; Q152C/L164C; Q152C/S166C; K153C/L164C; M154C/W163C; M154C/L164C; A172C/H66C; A171C/Y110C F173C/H66C; F173C/R85C | 1TNR, chain A | H32C; R51C; Y76C; P113C; L114C; L115C; S116C; S117C; Q118C; K119C; M120C; W129C; L130C; S132C; A137C; A138C; F139C; P161C; S162C; T163C | P113C/P161C; P113C/S162C; L114C/P161C; L114C/S162C; L115C/P161C; L115C/S162C; S116C/S162C; S116C/P161C; S116C/T163C; S117C/S132C; Q118C/L130C; Q118C/S132C; K119C/L130C; M120C/W129C; M120C/L130C; A137C/Y76C; A138C/H32C; F139C/H32C; F139C/R51C |
| LT-β (Gene names: LTB, TNFC, TNFSF3) | Q06643 (SEQ ID NO: 76), P78370, Q52LU8, Q99761 | H91C; Q110C; Y136C; L177C; L178C; L179C; E180C; G181C; A182C; E183C; T184C; W201C; Y202C; S204C; G209C; L210C; V211C; R233C; G234C; K235C | L177C/R233C; L177C/G234C; L178C/R233C; L178C/G234C; L179C/R233C; E180C/R233C; E180C/G234C; E180C/K235C; G181C/S204C; A182C/Y202C; A182C/S204C; E183C/Y202C; T184C/W201C; T184C/Y202C; G209C/Y136C; L210C/H91C; V211C/H91C; V211C/Q110C | 4MXW, chain B | (same as amino acid numbering based on UniPort Accession Nos) | (same as amino acid numbering based on UniPort Accession Nos) |
| OX4OL (Gene names: TNFSF4, TXGP1) | P23510 (SEQ ID NO: 112), Q5JZA5, Q9HCN9 | K63C; S104C; P125C; L126C; Q128C; L129C; K130C; S134C; M139C; V140C; A141C; N166C; G167C | P125C/N166C; L126C/N166C; Q128C/N166C; Q128C/G167C; L129C/S134C; K130C/S134C; M139C/S104C; V140C/K63C; A141C/K63C | 2HEV, chain F | (same as amino acid numbering based on UniPort Accession Nos) | (same as amino acid numbering based on UniPort Accession Nos) |

TABLE 1-continued

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| CD40L (Gene names: CD40LG, CD40L, TNFSF5, TRAP) | P29965 (SEQ ID NO: 132) | H125C; Y145C; Y172C; I204C; L205C; L206C; R207C; A208C; A209C; N210C; T211C; S213C; K216C; P217C; G219C; Q220C; S222C; G227C; V228C; F229C; T251C; G252C; F253C | I204C/T251C; I204C/G252C; L205C/T251C; L205C/G252C; L206C/T251C; R207C/T251C; R207C/G252C; R207C/F253C; A208C/S222C; A209C/Q220C; A209C/S222C; N210C/Q220C; T211C/G219C; T211C/Q220C; S213C/K216C; S213C/P217C G227C/Y172C; V228C/H125C; F229C/H125C; F229C/Y145C | 1ALY, chain A | (same as amino acid numbering based on UniPort Accession Nos) | (same as amino acid numbering based on UniPort Accession Nos) |
| FasL (Fas ligand) (Gene names: FASLG, APT1LG1, CD95L, FASL, TNFSF6) | P48023 (SEQ ID NO: 167), Q9BZP9 | H148C; I168C; Y192C; V223C; M224C; M225C; E226C; G227C; K228C; M229C; M230C; W239C; A240C; S242C; A247C; V248C; F249C; E271C; S272C; Q273C | V223C/E271C; V223C/S272C; M224C/E271C; M224C/S272C; M225C/E271C; E226C/E271C; E226C/S272C; E226C/Q273C; G227C/S242C; K228C/A240C; K228C/S242C; M229C/A240C; M230C/W239C; M230C/A240C; A247C/Y192C; V248C/H148C; F249C/H148C; F249C/I168C | 4MSV, chain A | (same as amino acid numbering based on UniPort Accession Nos) | (same as amino acid numbering based on UniPort Accession Nos) |
| CD70 (Gene names: CD70, CD27L, CD27LG, TNFSF7) | P32970 (SEQ ID NO: 203), Q53XX4, Q96J57 | R83C; H107C; T127C; L128C; A129C; V130C; G131C; I132C; S134C; S137C; S139; Q149C; G150C; C151S; T152C; R157C; T159C; T181C; D182C; E183C | T127C/T181C; T127C/D182C; L128C/T181C; L128C/D182C; A129C/T181C; V130C/T181C; V130C/D182C; V130C/E183C; G131C/T152C; I132C/G150C; I132C/T152C; S134C/Q149C; S134C/G150C; S137C/S139; G150C/C151S; R157C/H107C; T159C/R83C | 2RE9, chain B (30% sequence identity to CD70) | (same as amino acid numbering based on UniPort Accession Nos) | (same as amino acid numbering based on UniPort Accession Nos) |
| CD153 (Gene names: TNFSF8, protein CD30L, CD30LG) | P32971 (SEQ ID NO: 236), O43404 | Y101C; I142C; C151S; A172C; L173C; V174C; T175C; V176C; E178C; S179C; V186C; Y187C; N189C; L194C; L195C; D196C P220C; L221C; E222C | A172C/P220C; A172C/L221C; L173C/P220C; L173C/L221C; V174C/P220C; T175C/P220C; T175C/L221C; T175C/E222C; V176C/N189C; E178C/Y187C; S179C/V186C; S179C/Y187C; Y187C/C151S; | 2AZ5, chain B (complex with small molecule inhibitor) | (same as amino acid numbering based on UniPort Accession Nos) | (same as amino acid numbering based on UniPort Accession Nos) |

TABLE 1-continued

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| 4-1BB ligand (Gene names: TNFSF9) | P41273 (SEQ ID NO: 267), Q2M3S2 | Q94C; L115C A178C; L179C; L181C; T182C; V183C; D184C; L185C; N194C; S195C; F144C; F197C; R202C; L203C; L204C G231C; A232C | N189C/C151S; L194C/I142C; L195C/Y101C; D196C/Y101C A178C/G231C; L179C/G231C; L181C/G231C; L181C/A232C; T182C/F197C; V183C/S195C; V183C/F197C; D184C/S195C; L185C/N194C; L185C/S195C; R202C/F144C; L203C/Q94C; L204C/Q94C; L204C/L115C | 2X29, chain A | (same as amino acid numbering based on UniPort Accession Nos) | (same as amino acid numbering based on UniPort Accession Nos) |
| TRAIL (Gene names: TNFSF10, APO2L, TRAIL) | P50591 (SEQ ID NO: 297), A1Y9B3 | H125C; L147C; H161C; Y185C; L221C; L222C; M223C; K224C; S225C; R227C; N228C; C230S G238C; L239C; S241C; G246C; I247C; H270C; E271C; A272C | L221C/H270C; L221C/E271C; L222C/H270C; L222C/E271C; M223C/H270C; K224C/H270C; K224C/E271C; K224C/A272C; S225C/S241C; A226C/L239C; A226C/S241C; R227C/L239C; N228C/G238C; N228C/L239C; I247C/H125C; L147C/H161C; G246C/Y185C | 1D2Q, chain A | (same as amino acid numbering based on UniPort Accession Nos) | (same as amino acid numbering based on UniPort Accession Nos) |
| RANKL (Gene names: TNFSF11, OPGL, RANKL, TRANCE) | O14788 (SEQ ID NO: 333), O14723, Q96Q17, Q9P2Q3 | H167C; W193C; Y217C; T254C; L255C; M256C; K257C; G258C; G259C; S260C; W264C; G266C; H271C; F272C; S274C; G279C; F280C; F281C; Q303C; D304C; A305C | T254C/Q303C; T254C/D304C; L255C/Q303C; L255C/D304C; M256C/Q303C; K257C/Q303C; K257C/D304C; K257C/A305C; G258C/S274C; G259C/F272C; G259C/S274C; S260C/H271C; S260C/F272C; W264C/G266C; G279C/Y217C; F280C/H167C; F281C/H167C; F281C/W193C | 3URF, chain A | (same as amino acid numbering based on UniPort Accession Nos) | (same as amino acid numbering based on UniPort Accession Nos) |
| TWEAK (Gene names: TNFSF12, APO3L, DR3LG) | Q43508 (SEQ ID NO: 369), Q8IZK7, Q8WUZ7 | Y164C; L187C; A188C; L189C; R190C; L192C; E193C; E194C; Q206C; L207C; L209C; R208C; S213C; G214C; P238C; F239C; L240C | Y164C/S213C; Y164C/G214C; L187C/P238C; L187C/F239C; A188C/P238C; A188C/F239C; L189C/P238C; R190C/P238C; R190C/F239C; R190C/L240C; L192C/L207C; L192C/L209C; E193C/R208C; E194C/Q206C; E194C/L207C | 4HT1, chain T | Y69C; L92C; A93C; L94C; R95C; L97C; E98C; E99C; Q111C; L112C; R113C; L114C; S118C; G119C; P143C; F144C; L145C | L92C/P143C; L92C/F144C; A93C/P143C; A93C/F144C; L94C/P143C; R95C/P143C; R95C/F144C; R95C/L145C; L97C/L112C; L97C/L114C; E98C/R113C; E99C/Q111C; E99C/L112C; S118C/Y69C; G119C/Y69C |

TABLE 1-continued

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| APRIL (Gene names: TNFSF13, APRIL, TALL2, ZTNF2) | O75888 (SEQ ID NO: 398), A8MYD5, B4DVT2, Q541E1, Q5U0G8, Q96HV6, Q9P1M8, Q9P1M9 | H119C; S127C; A141C; Y166C; T192C; L193C; F194C; R195C; I197C; R198C; S199C; A207C; Y208C; S210C; C211S; G215C; V216C; F217C; P240C; H241C; G242C | T192C/P240C; T192C/H241C; L193C/P240C; L193C/H241C; F194C/P240C; R195C/P240C; R195C/H241C; R195C/G242C; I197C/Y208C; I197C/S210C; R198C/Y208C; S199C/A207C; S199C/Y208C; S210C/C211S; G215C/Y166C; V216C/H119C; F217C/H119C S127C/A141C | 1u5y chain A (murine structure, 85% sequence homology with human APRIL) | (same as amino acid numbering based on UniPort Accession Nos) | (same as amino acid numbering based on UniPort Accession Nos) |
| BLys (Gene names: TNFSF13B, BAFF, BLYS, TALL1, TNFSF20, ZTNF4) | Q9Y275 (SEQ ID NO: 435), E0ADT7, Q6FHD6, Q7Z5J2 | Q148C; Y196C; T228C; L229C; F230C; R231C; I233C; Q234C; N235C; P241C; N242C; S244C; G249C; I250C; A251C; G274C; D275C; V276C | T228C/G274C; T228C/D275C; L229C/G274C; L229C/D275C; F230C/G274C; R231C/G274C; R231C/D275C; R231C/V276C; I233C/N242C; I233C/S244C; Q234C/N242C; N235C/P241C; N235C/N242C; G249C/Y196C; I250C/Q148C; A251C/Q148C | 1KXG, chain A | (same as amino acid numbering based on UniPort Accession Nos) | (same as amino acid numbering based on UniPort Accession Nos) |
| LIGHT (Gene names: TNFSF14, HVEML, LIGHT) | O43557 (SEQ ID NO: 467), A8K7M2, C9J5H4, O75476, Q6FHA1, Q8WVF8, Q96LD2 | H97C; L120C; Y144C; E178C; L179C; L180C; V181C; S182C; Q183C; Q184C; S185C; G188C; T191C; W197C; W198C; S200C; G205C; V206C; V207C; G230C; T231C; R232C; | E178C/G230C; E178C/T231C; L179C/G230C; L179C/T231C; L180C/G230C; V181C/G230C; V181C/T231C; V181C/R232C; S182C/S200C; Q183C/W198C; Q183C/S200C; Q184C/W198C; S185C/W197C; S185C/W198C; G188C/T191C; G205C/Y144C; V206C/H97C; V207C/H97C; V207C/L120C | 4EN0, chain A | (same as amino acid numbering based on UniPort Accession Nos) | (same as amino acid numbering based on UniPort Accession Nos) |
| TL1 (Gene names: TNFSF15, TL1, VEGI) | O95150 (SEQ ID NO: 506), Q3SX69, Q5VJK8, Q5VWH1, Q8NFE9 | H98C; L125C; Y150C; Q193C; L194C; L195C; M196C; G197C; T198C; K199C; S200C; W208C; F209C; P211C; A216C; M217C; F218C; E241C; D242C; K243C | Q193C/E241C; Q193C/D242C; L194C/E241C; L194C/D242C; L195C/E241C; M196C/E241C; M196C/D242C; M196C/K243C; G197C/P211C; T198C/F209C; T198C/P211C; K199C/F209C; S200C/W208C; S200C/F209C; A216C/Y150C; | 2RE9, chain A | H27C; L54C; Y79C; Q122C; L123C; L124C; M125C; G126C; T127C; K128C; S129C; W137C; F138C; P140C; A145C; M146C; F147C; E170C; D171C; K172C | Q122C/E170C; Q122C/D171C; L123C/E170C; L123C/D171C; L124C/E170C; M125C/E170C; M125C/D171C; M125C/K172C; G126C/P140C; T127C/F138C; T127C/P140C; K128C/F138C; S129C/W137C; S129C/F138C; A145C/Y79C; |

TABLE 1-continued

| TNFSF ligand and TNF-like ligand | UniPort Accession Nos. | Single Cysteine Substitutions on Monomeric TNFSF Ligand (amino acid numbering based on UniPort Accession Nos.) | Pairs of Cysteine Substitutions on Monomeric TNFSF Ligand (amino acid numbering based on UniPort Accession Nos.) | PDB ID | Single Cysteine Substitutions on Monomeric TNFSF Ligand (amino acid numbering based on PDB ID.) | Pairs of Cysteine Substitutions on Monomeric TNFSF Ligand (amino acid numbering based on IDB ID.) |
|---|---|---|---|---|---|---|
| GITRL (also known as TL6) (Gene names: TNFSF18, AITRL, GITRL, TL6) | Q9UNG2 (SEQ ID NO: 542), A9IQG8, O95852, Q6ISV1 | K83C; Y120C; T148C; L149C; N184C; T150C; N151C; K152C; S153C; I155C; G160C; T161C; Y162C | M217C/H98C; F218C/H98C; F218C/L125C T148C/N184C; L149C/I155C; T150C/S153C; T150C/I155C; N151C/S153C; K152C/S153C; G160C/Y120C; T161C/K83C; Y162C/K83C | 3B93, chain A | K61C; Y98C; T126C; L127C; T128C; N129C; K130C; S131C; L133C; G138C; T139C; Y140C; N162C; V250C; H252C | M146C/H27C; F147C/H27C; F147C/L54C T126C/N162C; L127C/L133C; T128C/S131C; T128C/L133C; N129C/S131C; K130C/S131C; G138C/Y98C; T139C/K61C; Y140C/K61C |
| EDA (e.g., EDA-A1, EDA-A2) (Gene names: EDA, ED1, EDA2) | Q92838 (SEQ ID NO: 562), A0AUZ2, A2A337, B7ZLU2, B7ZLU4, O75910, Q5JS00, Q5JUM7, Q9UP77, Q9Y6L0, Q9Y6L1, Q9Y6L2, Q9Y6L3, Q9Y6L4 | V250C; H252C; T278C; Y304C; P328C; F329C; L330C; Q331C; T333C; R334C; S335C; N342C; Y343C; T345C; G350C; V351C; H376C; T377C; | P328C/H376C; F329C/H376C; L330C/H376C; L330C/T377C; Q331C/H376C; Q331C/T377C; T333C/Y343C; T333C/T345C; R334C/Y343C; S335C/N342C; S335C/Y343C; G350C/Y304C; V351C/V250C; V351C/H252C | 1RJ7, chain A; 1RJ8, chain A | (same as amino acid numbering based on UniPort Accession Nos) | (same as amino acid numbering based on Uniport Accession Nos) |
| Adiponectin (Gene names: ADIPOQ, ACDC, ACRP30, APM1, GBP28) | Q15848 (SEQ ID No: 688), Q58EX9 | S116C; A161C; A181C; M182C; L183C; F184C; T185C; Y186C; D187C; Q188C; N193C; V194C; Q196C; V201C; L202C; D229C; N230C; D231C | A181C/D229C; A181C/N230C; M182C/D229C; M182C/N230C; L183C/D229C; F184C/D229C; F184C/N230C; F184C/D231C; T185C/Q196C; Y186C/V194C; Y186C/Q196C; D187C/V194C; Q188C/N193C; Q188C/V194C; V201C/A161C; L202C/S116C | 4DOU, chain A | (same as amino acid numbering based on UniPort Accession Nos) | (same as amino acid numbering based on UniPort Accession Nos) |

TABLE 2

| TNFSF ligand and TNF-like ligand | UniPort Accession Nos. | Amino acid regions (amino acid numbering based on UniPort Accession Nos.) | PDB ID | Amino acid regions (amino acid numbering based on PDB ID.) |
|---|---|---|---|---|
| TNF-α (Gene names: TNF, TNFA, TNFSF2) | P01375 (SEQ ID NO: 1), O43647, Q9P1Q2, Q9UIV3 | amino acids 77-94, 107-113, 127-138, 165-204, and 220-228 | 1TNF, chain A | amino acids 1-18, 31-37, 51-62, 89-128, and 144-152 |
| LT-α (Gene names: LTA, TNFB, TNFSF1) | P01374 (SEQ ID NO: 40), Q8N4C3, Q9UKS8 | amino acids 52-69, 82-88, 107-113, 144-176, and 192-200 | 1TNR, chain A | amino acids 18-35, 48-54, 73-79, 110-142, and 158-166 |
| LT-β (Gene names: LTB, TNFC, TNFSF3) | Q06643 (SEQ ID NO: 76), P78370, Q52LU8, Q99761 | amino acids 77-94, 107-113, 133-139, 174-187, 199-214, and 230-238 | 4MXW, chain B | (same as amino acid numbering based on UniPort Accession Nos) |
| OX40L (Gene names: TNFSF4, TXGP1) | P23510 (SEQ ID NO: 112), Q5JZA5, Q9HCN9 | amino acids 49-66, 101-107, 122-144, and 163-170 | 2HEV, chain F | (same as amino acid numbering based on UniPort Accession Nos) |

TABLE 2-continued

| TNFSF ligand and TNF-like ligand | UniPort Accession Nos. | Amino acid regions (amino acid numbering based on UniPort Accession Nos.) | PDB ID | Amino acid regions (amino acid numbering based on PDB ID.) |
|---|---|---|---|---|
| CD40L (Gene names: CD40LG, CD40L, TNFSF5, TRAP) | P29965 (SEQ ID NO: 132) | amino acids 111-128, 142-148, 169-175, 201-232, and 248-256 | 1ALY, chain A | (same as amino acid numbering based on UniPort Accession Nos) |
| FasL (Fas ligand) (Gene names: FASLG, APT1LG1, CD95L, FASL, TNFSF6) | P48023 (SEQ ID NO: 167), Q9BZP9 | amino acids 134-151, 165-171, 189-195, 220-252, and 268-276 | 4MSV, chain A | (same as amino acid numbering based on UniPort Accession Nos) |
| CD70 (Gene names: CD70, CD27L, CD27LG, TNFSF7) | P32970 (SEQ ID NO: 203), Q53XX4, Q96J57 | amino acids 69-86, 104-110, 124-162, and 178-186 | 2RE9, chain B (30% sequence identity to CD70) | (same as amino acid numbering based on UniPort Accession Nos) |
| CD153 (Genenames: TNFSF8, protein CD30L, CD30LG) | P32971 (SEQ ID NO: 236), O43404 | amino acids 86-104, 169-199, and 217-225 | 2AZ5, chain B (complex with small molecule inhibitor) | (same as amino acid numbering based on UniPort Accession Nos) |
| 4-1BB ligand (Gene names: TNFSF9) | P41273 (SEQ ID NO: 267), Q2M352 | amino acids 80-97, 112-118, 175-207, and 228-235 | 2X29, chain A | (same as amino acid numbering based on UniPort Accession Nos) |
| TRAIL (Gene names: TNFSF10, APO2L, TRAIL) | P50591 (SEQ ID NO: 297), A1Y9B3 | amino acids 111-128, 144-150, 158-164, 182-188, 218-250, and 267-275 | 1D2Q, chain A | (same as amino acid numbering based on UniPort Accession Nos) |
| RANKL (Gene names: TNFSF11, OPGL, RANKL, TRANCE) | O14788 (SEQ ID NO: 333), O14723, Q96Q17, Q9P2Q3 | amino acids 153-170, 190-196, 214-220, 251-284, and 300-308 | 3URF, chain A | (same as amino acid numbering based on UniPort Accession Nos) |
| TWEAK (Gene names: TNFSF12, APO3L, DR3LG) | O43508 (SEQ ID NO: 369), Q8IZK7, Q8WUZ7 | amino acids 96-105, 161-167, 184-197, 204-217, and 235-243 | 4HT1, chain T | amino acids 1-10, 66-72, 89-102, 109-122, and 140-148 |
| APRIL (Gene names: TNFSF13, APRIL, TALL2, ZTNF2) | O75888 (SEQ ID NO: 398), A8MYD5, B4DVT2, Q541E1, Q5U0G8, Q96HV6, Q9P1M8, Q9P1M9 | amino acids 105-130, 138-144, 163-169, 189-220, and 237-245 | 1u5y chain A (murine structure, 85% sequence homology with human APRIL) | (same as amino acid numbering based on UniPort Accession Nos) |
| BLys (Gene names: TNFSF13B, BAFF, BLYS, TALL1, TNFSF20, ZTNF4) | Q9Y275 (SEQ ID NO: 435), E0ADT7, Q6FHD6, Q7Z5J2 | amino acids 134-151, 225-254, and 271-279 | 1KXG, chain A | (same as amino acid numbering based on UniPort Accession Nos) |
| LIGHT (Gene names: TNFSF14, HVEML, LIGHT) | O43557 (SEQ ID NO: 467), A8K7M2, C9J5H4, O75476, Q6FHA1, Q8WVF8, Q96LD2 | amino acids 83-100, 117-123, 175-210, and 227-235 | 4EN0, chain A | (same as amino acid numbering based on UniPort Accession Nos) |
| TL1 (Gene names: TNFSF15, TL1, VEGI) | O95150 (SEQ ID NO: 506), Q35X69, Q5VJK8, Q5VWH1, Q8NFE9 | amino acids 84-101, 122-128, 190-221, and 238-246 | 2RE9, chain A | amino acids 13-30, 51-57, 119-150, and 167-175 |
| GITRL (also known as TL6) (Gene names: TNFSF18, AITRL, GITRL, TL6) | Q9UNG2 (SEQ ID NO: 542), A9IQG8, O95852, Q615V1 | amino acids 69-86, 117-123, 145-165, 181-187, and 269-277 | 3B93, chain A | amino acids 47-64, 95-101, 123-143, 159-165, and 247-255 |
| EDA (e.g., FDA-A1, EDA-A2) (Gene names: EDA, ED1, EDA2) | Q92838 (SEQ ID NO: 562), A0AUZ2, A2A337, B7ZLU2, B7ZLU4, O75910, Q5JS00, Q5JUM7, Q9UP77, Q9Y6L0, Q9Y6L1, Q9Y6L2, Q9Y6L3, Q9Y6L4 | amino acids 238-255, 275-281, 301-307, 325-354, and 373-380 | 1RJ7, chain A; 1RJ8, chain A | (same as amino acid numbering based on UniPort Accession Nos) |
| Adiponectin (Gene names: ADIPOQ, ACDC, ACRP30, APM1, GBP28) | Q15848 (SEQ ID NO: 688), Q58EX9 | amino acids 103-119, 158-164, 178-205, and 226-234 | 4DOU, chain A | (same as amino acid numbering based on UniPort Accession Nos) |

Methods of Producing TNFSF and TNF-Like Ligand Muteins

TNFSF and TNF-like muteins of the invention can be produced from a host cell. A host cell refers to a vehicle that includes the necessary cellular components, e.g., organelles, needed to express the polypeptides and constructs described herein from their corresponding nucleic acids. The nucleic acids may be included in nucleic acid vectors that can be introduced into the host cell by conventional techniques known in the art (e.g., transformation, transfection, electroporation, calcium phosphate precipitation, direct microinjection, infection, etc). The choice of nucleic acid vectors depends in part on the host cells to be used. Generally, preferred host cells are of either prokaryotic (e.g., bacterial) or eukaryotic (e.g., mammalian) origin.

Nucleic Acid Vector Construction and Host Cells

A polynucleotide sequence encoding the amino acid sequence of a monomeric TNFSF or TNF-like ligand mutein may be prepared by a variety of methods known in the art. These methods include, but are not limited to, oligonucleotide-mediated (or site-directed) mutagenesis and PCR mutagenesis. A polynucleotide molecule encoding a TNFSF or TNF-like ligand mutein of the invention, e.g., a S171C/G224C double cysteine mutant of TNF-α, may be obtained using standard techniques, e.g., gene synthesis. Alternatively, a polynucleotide molecule encoding a wild-type TNFSF or TNF-like ligand may be mutated to contain specific cysteine substitutions, e.g., S171C/G224C of TNF-α, using standard techniques in the art, e.g., QuikChange™ mutagenesis. Polynucleotides can be synthesized using nucleotide synthesizer or PCR techniques.

Polynucleotide sequences encoding TNFSF or TNF-like ligand mutein polypeptides may be inserted into a vector capable of replicating and expressing the polynucleotides in prokaryotic or eukaryotic host cells. Many vectors are available in the art and can be used for the purpose of the invention. Each vector may contain various components that may be adjusted and optimized for compatibility with the particular host cell. For example, the vector components may include, but are not limited to: an origin of replication, a selection marker gene, a promoter, a ribosome binding site, a signal sequence, the polynucleotide sequence encoding protein of interest, and a transcription termination sequence. In some embodiments, a vector can include internal ribosome entry site (IRES) that allows the expression of multiple TNFSF or TNF-like ligand muteins. Some examples of bacterial expression vectors include, but are not limited to, pGEX series of vectors (e.g., pGEX-2T, pGEX-3X, pGEX-4T, pGEX-5X, pGEX-6P), pET series of vectors (e.g., pET-21, pET-21a, pET-21b, pET-23, pET-24), pACYC series of vectors (e.g., pACYDuet-1), pDEST series of vectors (e.g., pDEST14, pDEST15, pDEST24, pDEST42), and pBR322 and its derivatives (see, e.g., U.S. Pat. No. 5,648,237). Some examples of mammalian expression vectors include, but are not limited to, pCDNA3, pCDNA4, pNICE, pSELECT, and pFLAG-CMV.

In some embodiments, *E. coli* cells are used as host cells for the invention. Examples of *E. coli* strains include, but are not limited to, *E. coli* 294 (ATCC®31,446), *E. coli* Å 1776 (ATCC® 31,537, *E. coli* BL21 (DE3) (ATCC® BAA-1025), and *E. coli* RV308 (ATCC®31,608). In other embodiments, mammalian cells are used as host cells for the invention. Examples of mammalian cell types include, but are not limited to, human embryonic kidney (HEK) cells, Chinese hamster ovary (CHO) cells, HeLa cells, PC3 cells, Vero cells, and MC3T3 cells. Different host cells have characteristic and specific mechanisms for the posttranslational processing and modification of protein products. Appropriate cell lines or host systems may be chosen to ensure the correct modification and processing of the protein expressed. The above-described expression vectors may be introduced into appropriate host cells using conventional techniques in the art, e.g., transformation, transfection, electroporation, calcium phosphate precipitation, and direct microinjection. Once the vectors are introduced into host cells for protein production, host cells are cultured in conventional nutrient media modified as appropriate for inducing promoters, selecting transformants, or amplifying the genes encoding the desired sequences.

In a preferred embodiment, a polynucleotide sequence encoding a TNFSF or TNF-like mutein polypeptide, e.g., a S171C/G224C double cysteine mutant of TNF-α, may be cloned into a bacterial expression vector, e.g., a pDEST42 vector. The pDEST42 vector contains a bacteriophage T7 inducible promoter and an ampicillin-resistant selection marker gene. Positive clones may be transformed into bacterial host cell, e.g., BL21 (DE3) pLysS, for expression the TNFSF or TNF-like ligand mutein.

Other types of nucleic acid vectors include viral vectors for expressing a protein in a cell (e.g., a cell of a subject). Such viral vectors include, but are not limited to, retroviral vectors, adenoviral vectors, poxviral vectors (e.g., vaccinia viral vectors, such as Modified Vaccinia Ankara (MVA)), adeno-associated viral vectors, and alphaviral vectors.

Protein Production, Recovery, and Purification

Host cells used to produce the TNFSF or TNF-like ligand mutein polypeptides of the invention may be grown in media known in the art and suitable for culturing of the selected host cells. Examples of suitable media for bacterial host cells include Luria broth (LB) plus necessary supplements, such as a selection agent, e.g., ampicillin. Examples of suitable media for mammalian host cells include Minimal Essential Medium (MEM), Dulbecco's Modified Eagle's Medium (DMEM), DMEM with supplemented fetal bovine serum (FBS), and RPMI-1640.

Host cells are cultured at suitable temperatures, such as from about 20° C. to about 39° C., e.g., from 25° C. to about 37° C. The pH of the medium is generally from about 6.8 to 7.4, e.g., 7.0, depending mainly on the host organism. If an inducible promoter is used in the expression vector of the invention, protein expression is induced under conditions suitable for the activation of the promoter.

Protein recovery typically involves disrupting the host cell, generally by such means as osmotic shock, sonication, or lysis. Once the cells are disrupted, cell debris may be removed by centrifugation or filtration. The proteins may be further purified, for example, by affinity resin chromatography. Standard protein purification methods known in the art can be employed. The following procedures are exemplary of suitable purification procedures: fractionation on immunoaffinity or ion-exchange columns, ethanol precipitation, reverse phase HPLC, chromatography on silica or on a cation-exchange resin, SDS-PAGE, and gel filtration. In some embodiments, the purification procedure also involves removing monomeric TNFSF and TNF-like muteins using conventional techniques in the art, e.g., size-exclusion chromatography.

In a preferred embodiment, a seed culture of transformed *E. coli* BL21 cells may be used to inoculate a large volume of LB, e.g. 2-10 liters. The BL21 culture may be grown to an optical density (OD) of A600=0.8. Protein expression may be induced with IPTG at 0.1 mM. After IPTG induction, cells may be grown at 18° C. for 10-20 hours, preferably 16 hours. Subsequently, cells may be harvested by centrifugation and lysed using conventional techniques in the art to obtain a cell culture supernatant. In some embodiments, a Ni-NTA column may be used for affinity purification of a polyhistidine-tagged TNFSF or TNF-like ligand mutein of the invention. The polyhistidine tag binds with micromolar affinity to NTA (nitrilotriacetic acid)-chelated Ni. After loading the cell culture supernatant to the Ni-NTA column, the polyhistidine-tagged protein remains bound to the column. The column may be washed with phosphate buffer to remove unwanted proteins that do not specifically interact with the Ni ion. Finally, the desired protein, e.g., TNFSF or TNF-like ligand muteins of the invention, may be eluted off the Ni-NTA column with 150-300 mM imidazole. The size and purity of the recovered TNFSF or TNF-like ligand mutein may be assayed using SDS-PAGE gel and/or Western blot.

Alternatively, TNFSF and TNF-like ligand mutein polypeptides can be produced by the cells of a subject (e.g., a human), e.g., in the context of therapy, by administrating a vector (e.g., a retroviral vector, adenoviral vector, poxviral vector (e.g., vaccinia viral vector, such as Modified Vaccinia Ankara (MVA)), adeno-associated viral vector, and alphaviral vector) containing a nucleic acid molecule encoding the TNFSF or TNF-like ligand mutein (e.g., a TNF-α mutein). The vector, once inside a cell of the subject (e.g., by transformation, transfection, electroporation, calcium phosphate precipitation, direct microinjection, infection, etc) will promote expression of the TNFSF or TNF-like ligand mutein, which is then secreted from the cell as a multimer (e.g., a homo-trimer). If treatment of a disease or disorder is the desired outcome, no further action may be required. If collection of the protein is desired, blood may be collected from the subject and the protein purified from the blood by methods known in the art.

Pharmaceutical Compositions and Preparations

In some embodiments, pharmaceutical compositions of the invention may contain one or more TNFSF or TNF-like ligand muteins of the invention as the therapeutic proteins. In addition to a therapeutic amount of the protein, the pharmaceutical compositions may contain a pharmaceutically acceptable carrier or excipient, which can be formulated by methods known to those skilled in the art. In other embodiments, pharmaceutical compositions of the invention may contain nucleic acid molecules encoding one or more TNFSF ligand muteins of the invention (e.g., in a vector, such as a viral vector). Preferably, TNFSF or TNF-like ligand muteins in the pharmaceutical compositions of the invention are composed of complexes of two, three, four, or more, preferably three, TNFSF or TNF-like ligand muteins or fragments thereof that are covalently bonded (e.g., disulfide bonded). In some embodiments, pharmaceutical compositions of the invention may contain monomeric TNFSF or TNF-like ligand muteins. Preferably, TNFSF or TNF-like ligand muteins in the pharmaceutical compositions of the invention are soluble TNFSF or TNF-like ligand muteins lacking the transmembrane domain, and optionally, also the cytoplasmic domain, or both domains.

TNFSF and TNF-like ligand muteins of the invention include monomers and homo-multimers of TNFSF or TNF-like ligand muteins. Each mutein includes at least one cysteine residue substitution or insertion that promotes the formation of a disulfide bond with another cysteine residue on a neighboring TNFSF or TNF-like ligand mutein. Multimers of TNFSF or TNF-like ligand muteins of the invention are composed of two, three, four, or more TNFSF or TNF-like ligand muteins or fragments thereof that are covalently bonded (e.g., disulfide bonded). In some embodiments, each TNFSF or TNF-like ligand mutein or fragment thereof has, in addition to the cysteine substitution(s) and insertion(s), at least 50% sequence identity (e.g., 50%, 55%, 60%, 65%, 70%, 75%, 80%, 85%, 90%, 95%, 99%, or 100%) to a sequence selected from any one of SEQ ID NOs: 1-735 or a biologically active fragment thereof.

In some embodiments, a pharmaceutical composition of the invention may contain a TNF-α mutein of the invention. Preferably, the TNF-α mutein is a soluble TNF-α mutein that forms a TNF-α homo-trimer, with each monomer containing one or more of the following cysteine substitutions: H91C, N110C, N168C, L169C, L170C, S171C, A172C, I173C, K174C, S175C, Q178C, E180C, W190C, Y191C, P193C, V199C, F200C, S223C, G224C, and Q225C. In other embodiments, the TNF-α mutein is a soluble TNF-α mutein that forms a TNF-α homo-trimer (e.g., via disulfide bond formation), with each monomer containing one or more (preferably one) of the following pairs of cysteine substitutions: N92C/S147C, N92C/G224C, L93C/S147C, L93C/G224C, L94C/S147C, S171C/S147C, S171C/G224C, S171C/Q149C, A96C/P117C, I97C/Y115C, I97C/P117C, K98C/Y115C, S99C/W114C, S99C/Y115C, Q102C/E104C, V123C/H15C, F124C/H15C, and F124C/N34C. In a preferred embodiment, the pharmaceutical composition of the invention contains a TNF-α mutein of the invention that forms a TNF-α homo-trimer (e.g., via disulfide bond formation), with each monomer containing the amino acid substitution S171C, G224C, or both.

Pharmaceutical compositions of the invention may contain nucleic acid molecules encoding one or more of TNFSF or TNF-like ligand muteins of the invention. The nucleic acid molecule encoding a TNFSF or TNF-like ligand mutein may be cloned into an appropriate expression vector, which may be delivered via well-known methods in gene therapy. Vectors that may be used for in vivo gene delivery and expression include, but are not limited to, retroviral vectors, adenoviral vectors, poxviral vectors (e.g., vaccinia viral vectors, such as Modified Vaccinia Ankara (MVA)), adeno-associated viral vectors, and alphaviral vectors. In some embodiments, a vector can include an internal ribosome entry site (IRES) that allows the expression of multiple TNFSF or TNF-like ligand muteins. The vector-delivered nucleic acid molecules encoding TNFSF or TNF-like ligand muteins may be expressed and form homo-multimers, e.g., homo-trimers, in situ or in vivo. In some embodiments, the nucleic acid molecule may encode a TNFSF or TNF-like ligand mutein or fragment thereof that has at least 50% sequence identity (e.g., 50%, 55%, 60%, 65%, 70%, 75%, 80%, 85%, 90%, 95%, 99%, or 100%) to a sequence selected from any one of SEQ ID NOs: 1-735 or a biologically active fragment thereof. In some embodiments, the pharmaceutical composition of the invention may contain a nucleic acid molecule that encodes a TNF-α mutein of the invention. Preferably, the nucleic acid molecule encodes a TNF-α mutein having one or more of the following cysteine substitutions: H91C, N110C, N168C, L169C, L170C, S171C, A172C, I173C, K174C, S175C, Q178C, E180C, W190C, Y191C, P193C, V199C, F200C, S223C, G224C, and Q225C. In other embodiments, the nucleic acid molecule encodes a TNF-α mutein having one or more (preferably one) of the following pairs of cysteine substitutions: N92C/S147C, N92C/G224C, L93C/S147C, L93C/G224C, L94C/S147C, S171C/S147C, S171C/G224C, S171C/Q149C, A96C/P117C, I97C/Y115C, I97C/P117C, K98C/Y115C, S99C/W114C, S99C/Y115C, Q102C/E104C, V123C/H15C, F124C/H15C, and F124C/N34C. In a preferred embodiment, the pharmaceutical composition of the invention contains a nucleic acid molecule that encodes a TNF-α mutein having amino acid substitution S171C, G224C, or both.

In other embodiments, the pharmaceutical compositions of the invention may contain one or more TNFSF and TNF-like ligand muteins, or nucleic acid molecules encoding such muteins, of other TNFSF and TNF-like ligands aside from TNF-α, e.g., lymphotoxin (e.g., LT-α and RANKL), OX40L, CD40L, FasL, CD70, RANKL, 4-1BB ligand, TRAIL, RANKL, TWEAK, APRIL, BLys, LIGHT, TL1, GITRL (also known as TL6), EDA (e.g., EDA-A1 and EDA-A2), and adiponectin, as the therapeutic proteins.

Acceptable carriers and excipients in the pharmaceutical compositions are nontoxic to recipients at the dosages and concentrations employed. Acceptable carriers and excipients may include buffers such as phosphate, citrate, HEPES, and TAE, antioxidants such as ascorbic acid and methionine, preservatives such as hexamethonium chloride, octadecyldimethylbenzyl ammonium chloride, resorcinol, and benzalkonium chloride, proteins such as human serum albumin, gelatin, dextran, and immunoglobulins, hydrophilic polymers such as polyvinylpyrrolidone, amino acids such as glycine, glutamine, histidine, and lysine, and carbohydrates such as glucose, mannose, sucrose, and sorbitol. Pharmaceutical compositions of the invention can be administered parenterally in the form of an injectable formulation. Pharmaceutical compositions for injection can be formulated using a sterile solution or any pharmaceutically acceptable liquid as a vehicle. Pharmaceutically acceptable vehicles include, but are not limited to, sterile water, physiological saline, and cell culture media (e.g., Dulbecco's Modified Eagle Medium (DMEM), α-Modified Eagles Medium (α-MEM), F-12 medium).

The pharmaceutical compositions of the invention may be prepared in microcapsules, such as hydroxylmethylcellulose or gelatin-microcapsule and poly-(methylmethacrylate) microcapsule. The pharmaceutical compositions of the invention may also be prepared in other drug delivery systems such as liposomes, albumin microspheres, microemulsions, nano-particles, and nanocapsules. Such techniques are described in Remington: The Science and Practice of Pharmacy 20th edition (2000). The pharmaceutical compositions to be used for in vivo administration must be sterile. This is readily accomplished by filtration through sterile filtration membranes.

The pharmaceutical compositions of the invention may also be prepared as a sustained-release formulation. Suitable examples of sustained-release preparations include semipermeable matrices of solid hydrophobic polymers containing the TNFSF or TNF-like ligand muteins of the invention. Examples of sustained release matrices include polyesters, hydrogels, polyactides (U.S. Pat. No. 3,773,919), copolymers of L-glutamic acid and y ethyl-L-glutamate, non-degradable ethylene-vinyl acetate, degradable lactic acid-glycolic acid copolymers such as LUPRON DEPOT™, and poly-D-(−)-3-hydroxybutyric acid. Some sustained-release formulations enable release of molecules over a few months, e.g., one to six months, while other formulations release pharmaceutical compositions of the invention for shorter time periods, e.g., days to weeks.

The pharmaceutical composition may be formed in a unit dose form as needed. The amount of active component, e.g., disulfide-bonded multimeric TNFSF or TNF-like ligand mutein complexes, included in the pharmaceutical preparations is such that a suitable dose within the designated range is provided (e.g., a dose within the range of 0.01-100 mg/kg of body weight).

The pharmaceutical composition for gene therapy can be in an acceptable diluent, or can comprise a slow release matrix in which the gene delivery vehicle is imbedded. Vectors that may be used as in vivo gene delivery vehicle include, but are not limited to, retroviral vectors, adenoviral vectors, poxviral vectors (e.g., vaccinia viral vectors, such as Modified Vaccinia Ankara (MVA)), adeno-associated viral vectors, and alphaviral vectors. In some embodiments, a vector can include internal ribosome entry site (IRES) that allows the expression of multiple TNFSF and TNF-like ligand muteins. Other vehicles and methods for gene delivery are described in U.S. Pat. Nos. 5,972,707, 5,697,901, and 6,261,554, each of which is incorporated by reference in its entirety.

Other methods of producing pharmaceutical compositions are described in, e.g., U.S. Pat. Nos. 5,478,925, 8,603,778, 7,662,367, and 7,892,558, and WO1996003141, all of which are incorporated herein by reference in their entireties.

Routes, Dosage, and Timing of Administration

Pharmaceutical compositions of the invention that contain one or more TNFSF and TNF-like ligand muteins as the therapeutic proteins may be formulated for parenteral administration, subcutaneous administration, intravenous administration, intramuscular administration, intra-arterial administration, intrathecal administration, or interperitoneal administration (intravenous administration is particularly suitable). The pharmaceutical composition may also be formulated for, or administered via, nasal, spray, oral, aerosol, rectal, or vaginal administration. Methods of administering therapeutic proteins are known in the art. See, for example, U.S. Pat. Nos. 6,174,529, 6,613,332, 8,518,869, 7,402,155, and, 6,591,129, and U.S. Patent Application Publication Nos. US20140051634, WO1993000077, US20110184145, the disclosures of which are incorporated by reference in their entireties. One or more of these methods may be used to administer a pharmaceutical composition of the invention that contains one or more TNFSF and TNF-like ligand muteins of the invention. For injectable formulations, various effective pharmaceutical carriers are known in the art. See, e.g., Pharmaceutics and Pharmacy Practice, J. B. Lippincott Company, Philadelphia, Pa., Banker and Chalmers, eds., pages 238-250 (1982), and ASHP Handbook on Injectable Drugs, Toissel, 4th ed., pages 622-630 (1986).

The dosage of the pharmaceutical compositions of the invention depends on factors including the route of administration, the disease to be treated, and physical characteristics, e.g., age, weight, general health, of the subject. Typically, the amount of a TNFSF or TNF-like ligand mutein of the invention contained within a single dose may be an amount that effectively prevents, delays, or treats the disease without inducing significant toxicity. A pharmaceutical composition of the invention may include a dosage of a TNFSF or TNF-like ligand mutein or disulfide-bonded homo-multimeric complex thereof, ranging from 0.001 to 500 mg (e.g., 0.05, 0.01, 0.1, 0.2, 0.3, 0.5, 0.7, 0.8, 1 mg, 2 mg, 3 mg, 4 mg, 5 mg, 10 mg, 15 mg, 20 mg, 30 mg, 50 mg, 100 mg, 250 mg, or 500 mg) and, in a more specific embodiment, about 0.1 to about 100 mg and, in a more specific embodiment, about 0.2 to about 20 mg. The dosage may be adapted by the clinician in accordance with conventional factors such as the extent of the disease and different parameters of the subject.

A pharmaceutical composition of the invention can be administered in an amount from about 0.001 mg up to about 500 mg/kg/day (e.g., 0.05, 0.01, 0.1, 0.2, 0.3, 0.5, 0.7, 0.8, 1 mg, 2 mg, 3 mg, 4 mg, 5 mg, 10 mg, 15 mg, 20 mg, 30 mg, 50 mg, 100 mg, 250 mg, or 500 mg/kg/day). Pharmaceutical compositions of the invention that contain a TNFSF or TNF-like ligand mutein may be administered to a subject in need thereof, for example, one or more times (e.g., 1-10 times or more) daily, weekly, monthly, biannually, annually, or as medically necessary. Dosages may be provided in either a single or multiple dosage regimens. For example, in some embodiments, the effective amount is a dose that ranges from about 0.1 to about 100 mg/kg/day, from about 0.2 mg to about 20 mg of the TNFSF or TNF-like ligand mutein per day, about 1 mg to about 10 mg of the TNFSF or TNF-like ligand mutein per day, from about 0.7 mg to about 210 mg of the TNFSF or TNF-like ligand mutein per week, 1.4 mg to about 140 mg of the TNFSF or TNF-like ligand mutein per week, about 0.3 mg to about 300 mg of the TNFSF or TNF-like ligand mutein every three days, about 0.4 mg to about 40 mg of the TNFSF or TNF-like ligand mutein every other day, and about 2 mg to about 20 mg of the TNFSF or TNF-like ligand mutein every other day. The timing between administrations may decrease as the medical condition improves or increase as the health of the patient declines.

Methods of Treatment Using Covalently Cross-Linked Multimers of TNFSF or TNF-Like Ligand Muteins The invention provides pharmaceutical compositions containing one or more TNFSF or TNF-like ligand muteins that may be used to treat patients who are suffering from diseases and disorders, such as autoimmune diseases (e.g., Alopecia Areata, Ankylosing Spondylitis, Antiphospholipid Syndrome, Addison's Disease, Hemolytic Anemia, Autoimmune Hepatitis, Hepatitis, Behcets Disease, Bullous Pemphigoid, Cardiomyopathy, Celiac Sprue-Dermatitis, Chronic Fatigue Immune Dysfunction Syndrome (CFIDS), Chronic Inflammatory Demyelinating Polyneuropathy, Churg-Strauss Syndrome, Cicatricial Pemphigoid, Limited Scleroderma (CREST Syndrome), Cold Agglutinin Disease, Crohn's Disease, Discoid Lupus, Essential Mixed Cryoglobulinemia, Fibromyalgia-Fibromyositis, Graves' Disease, Guillain-Barré Syndrome, Hashimoto's Thyroiditis, Hypothyroidism, Inflammatory Bowel Disease, autoimmune lymphoproliferative syndrome (ALPS), Idiopathic Pulmonary Fibrosis, Idiopathic Thrombocytopenia Purpura (ITP), IgA Nephropathy, Insulin dependent Diabetes, Juvenile Arthritis, Lichen Planus, Lupus, Meniere's Disease, Mixed Connective Tissue Disease, Multiple Sclerosis, Myasthenia Gravis, Pemphigus Vulgaris, Pernicious Anemia, Polyarteritis Nodosa, Polychondritis, Polyglandular Syndromes, Polymyalgia Rheumatica, Polymyositis, Dermatomyositis, Primary Agammaglobulinemia, Primary Biliary Cirrhosis, Psoriasis, Raynaud's Phenomenon, Reiter's Syndrome, Rheumatic Fever, Rheumatoid Arthritis, Sarcoidosis, Scleroderma, Sjögren's Syndrome, Stiff-Man Syndrome, Takayasu Arteritis, Temporal Arteritis/Giant Cell Arteritis, Ulcerative Colitis, Uveitis, Vasculitis, Vitiligo, and Wegener's Granulomatosis, and insulin dependent diabetes, preferably said autoimmune disease is Insulin dependent Diabetes, Rheumatoid Arthritis, Sjögren's Syndrome, Multiple Sclerosis, and Crohn's Disease), neurological diseases (e.g., a brain tumor, a brain metastasis, schizophrenia, epilepsy, Amyotrophic lateral sclerosis (ALS), Parkinson's disease, Alzheimer's disease, Huntington's disease, and stroke, preferably said neurological disease is Amyotrophic lateral sclerosis (ALS), Parkinson's disease, and Alzheimer's disease), cancers (e.g., bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, and oligoastrocytoma), infectious diseases, metabolic diseases (e.g., diabetes), macular diseases (e.g., macular degeneration), muscular atrophy, diseases related to miscarriage, vascular diseases (e.g., atherosclerosis), diseases related to bone loss (i.e., bone loss as a result of menopause, osteoprosis), allergies, blood disorders (e.g., hemophilia), AIDS, musculoskeletal disorders, diseases related to growth receptors, obesity, and complications resulting from tissue or organ repairs, regenerations, or transplantations (e.g., graft-versus-host disease (GVHD) and graft rejection), or patients in need of organ or tissue regeneration or repair (e.g., autoimmune disease patients, such as a type 1 diabetes patient).

A pharmaceutical composition of the invention containing a TNFSF or TNF-like ligand mutein may be used to treat a medical condition including, but not limited to, an autoimmune disease and cancer (e.g., bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcoma, carcinoma, non-small cell lung carcinoma, non-Hodgkin's lymphoma, acute myeloid leukemia (AML), chronic lymphocytic leukemia (CLL), B-cells chronic lymphocytic leukemia (B-CLL), multiple myeloma (MM), erythroleukemia, renal cell carcinoma, soft tissue sarcoma, melanoma, astrocytoma, or oligoastrocytoma). For treating one or more of these medical conditions, the pharmaceutical composition may include an amount of the covalently cross-linked (e.g., disulfide bonded) multimer of the TNFSF or TNF-like ligand mutein that is administered to patients in need thereof.

The pharmaceutical compositions of the invention may be used in the treatment of autoimmune diseases, e.g., Alopecia Areata, Ankylosing Spondylitis, Antiphospholipid Syndrome, Addison's Disease, Hemolytic Anemia, Autoimmune Hepatitis, Hepatitis, Behcets Disease, Bullous Pemphigoid, Cardiomyopathy, Celiac Sprue-Dermatitis, Chronic Fatigue Immune Dysfunction Syndrome (CFIDS), Chronic Inflammatory Demyelinating Polyneuropathy, Churg-Strauss Syndrome, Cicatricial Pemphigoid, Limited Scleroderma (CREST Syndrome), Cold Agglutinin Disease, Crohn's Disease, Discoid Lupus, Essential Mixed Cryoglobulinemia, Fibromyalgia-Fibromyositis, Graves' Disease, Guillain-Barré Syndrome, Hashimoto's Thyroiditis, Hypothyroidism, Inflammatory Bowel Disease, autoimmune lymphoproliferative syndrome (ALPS), Idiopathic Pulmonary Fibrosis, Idiopathic Thrombocytopenia Purpura (ITP), IgA Nephropathy, Insulin dependent Diabetes, Juvenile Arthritis, Lichen Planus, Lupus, Meniere's Disease, Mixed Connective Tissue Disease, Multiple Sclerosis, Myasthenia Gravis, Pemphigus Vulgaris, Pernicious Anemia, Polyarteritis Nodosa, Polychondritis, Polyglandular Syndromes, Polymyalgia Rheumatica, Polymyositis, Dermatomyositis, Primary Agammaglobulinemia, Primary Biliary Cirrhosis, Psoriasis, Raynaud's Phenomenon, Reiter's Syndrome, Rheumatic Fever, Rheumatoid Arthritis, Sarcoidosis, Scleroderma, Sjögren's Syndrome, Stiff-Man Syndrome, Takayasu Arteritis, Temporal Arteritis/Giant Cell Arteritis, Ulcerative Colitis, Uveitis, Vasculitis, Vitiligo, and Wegener's Granulomatosis.

Preferably, the autoimmune disease is insulin dependent diabetes (also known as type 1 diabetes or autoimmune diabetes), multiple sclerosis, rheumatoid arthritis, Sjögren's syndrome, Crohn's disease, thyroiditis, lupus, or dermatitis. Administration of a pharmaceutical composition containing a TNFSF or TNF-like ligand mutein, e.g., a homo-trimeric TNF-α mutein complex (e.g., a complex in which each monomer contains S171C and G224C substitutions), selectively kills autoreactive T cells and/or promotes the proliferation of healthy T cells, e.g., T-regulatory cells. In one embodiment, the TNFSF ligand mutein is a TNF-α mutein (e.g., a S171C/G224C TNF-α mutein) that is present in a disulfide-bonded homo-trimeric complex.

The pharmaceutical compositions of the invention may be used in the treatment of neurological diseases, e.g., a brain tumor, a brain metastasis, schizophrenia, epilepsy, amyotrophic lateral sclerosis (ALS), Parkinson's disease, Alzheimer's disease, Huntington's disease, and stroke. Preferably, the neurological disease is amyotrophic lateral sclerosis (ALS), Parkinson's disease, or Alzheimer's disease. Preferably, the pharmaceutical compositions of the invention contain one or more TNFSF or TNF-like ligand muteins. In one embodiment, the TNFSF ligand mutein is a TNF-α mutein (e.g., a S171C/G224C TNF-α mutein) that is present in a disulfide-bonded homo-trimeric complex.

In some embodiments, the pharmaceutical compositions of the invention may be used in combination with one or more chemotherapy agents in a cancer treatment. In some embodiments, the pharmaceutical compositions of the invention may be used in combination with one or more immunotherapy agents in a cancer treatment, e.g., tumor selective T-cell activation, dendritic cell therapy, antibody therapy, and cytokine therapy.

Chemotherapy agents used in a cancer treatment may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus. Other chemotherapy agents include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott et al.

Additional chemotherapy agents that may be used in combination with the pharmaceutical compositions of the invention in a cancer treatment include 06-benzylguanine, 13-cis retinoic acid, 14-hydroxy-retro-retinol, 2' deoxyformycin, 20-pi-1,25 dihydroxyvitamin D3, 2chloro-2'-arabino-fluoro-2'-deoxyadenosine, 2-chloro-2'-deoxyadenosine, 2-chlorodeoxyadenosine, 2-chlorodeoxyadenosine (2-Cda), 2'deoxycoformycin (DCF), 3-methyl TTNEB, 5-ethynyluracil, 5-fdump, 6-mercaptopurine, 6-thioguanine, 9-aminocamptothecin, 9-cis retinoic acid, a. metantrone acetate, abiraterone, acivicin, aclarubicin, acodazole hydrochloride, acronine, acylfulvene, adecypenol, adozelesin, adriamycin, aldesleukin, ALL-TK antagonists, all-trans retinoic acid, all-trans retinol, altretamine, ambamustine, ambomycin, amidox, amifostine, aminoglutethimide, aminolevulinic acid, amrubicin, amsacrine, anagrelide, anastrozole, andrographolide, angiogenesis inhibitors, anisomycin, antagonist D, antagonist G, antarelix, anthramycin, antiandrogen, prostatic carcinoma, anti-dorsalizing morphogenetic protein-1, antiestrogen, antineoplaston, antisense oligonucleotides, aphidicolin glycinate, apoptosis gene modulators, apoptosis regulators, apurinic acid, ara-CDP-DL-PTBA, argininedeaminase, asparaginase, asperlin, asulacrine, atamestane, atrimustine, axinastatin 1, axinastatin 2, axinastatin 3, azacitidine, azasetron, azatoxin, azatyrosine, azetepa, azotomycin, AZQ, B, R=Me), baccatin III derivatives, balanol, batimastat, BCR/ABL antagonists, benzochlorins, benzodepa, benzoylstaurosporine, beta lactam derivatives, beta-alethine, betaclamycin B, betulinic acid, bFGF inhibitor, bicalutamide, Bis (platinum), bisantrene, bisantrene hydrochloride, bisaziridinylspermine, bisnafide, bisnafide dimesylate, bistratene A, bizelesin, bleomycin A2, bleomycin B2, bleomycin sulfate, breflate, brequinar sodium, bropirimine, budotitane, busulfan, buthionine sulfoximine, cactinomycin, calcipotriol, calphostin C, calusterone, camptothecin, camptothecin derivatives (e.g., 10-hydroxy-camptothecin), canarypox IL-2, capecitabine, caracemide, carbetimer, carboplatin, carboxamide-amino-triazole, carboxyamidotriazole, CaRest M3, carmustine, CARN 700, cartilage derived inhibitor, carubicin hydrochloride, carzelesin, casein kinase inhibitors (ICOS), castanospermine, cecropin B, cedefingol, CEP-751, cetrorelix, chlorambucil, chlorins, chloroquinoxaline sulfonamide, cicaprost, cirolemycin, cisplatin, cis-porphyrin, cladribine, clomifene analogues, clotrimazole, collismycin A, collismycin B, combretastatin A4, combretastatin analogue, combretestatin a-4, conagenin, CPT-11, crambescidin 816, crisnatol, crisnatol mesylate, cryptophycin 8, cryptophycin A derivatives, curacin A, cyclopentanthraquinones, cyclophosphamide, cycloplatam, cypemycin, cytarabine, cytarabine ocfosfate, cytolytic factor, cytostatin, daca(n-[2-(dimethyl-amino)-ethyl] acridine-4-carboxamide), dacarbazine, dacliximab, dactinomycin, Dactinomycin (Actinomycin D), darubicin, daunomycin, daunorubicin hydrochloride, decitabine, dehydrodidemnin B, deslorelin, dexifosfamide, dexormaplatin, dexrazoxane, dexverapamil, dezaguanine, dezaguanine mesylate, diacarbazine (DTIC), diaziquone, didemnin B, didox, diethylnorspermine, dihydro-5-azacytidine, dihydrotaxol, 9-, dioxamycin, diphenyl spiromustine, discodermolide, docetaxel, docosanol, dolasatins, dolasetron, doxifluridine, doxorubicin, doxorubicin hydrochloride, droloxifene, droloxifene citrate, dromostanolone propionate, dronabinol, duazomycin, duocarmycin SA, DWA 2114R, ebselen, ecomustine, edatrexate, edelfosine, edrecolomab, eflornithine, eflornithine hydrochloride, elemene, ellipticine, elsamitrucin, emitefur, enloplatin, enpromate, epipropidine, epirubicin, epirubicin hydrochloride, epithilones, epothilones (A, R=H, episteride, erbulozole, esorubicin hydrochloride, estramustine, estramustine analogue, estramustine phosphate sodium, estrogen agonists, estrogen antagonists, etanidazole, ethiodized oil i 131, etoposide, etoposide 4'-phosphate (etopofos), etoposide phosphate, etoprine, exemestane, fadrozole, fadrozole hydrochloride, fazarabine, fenretinide, filgrastim, finasteride, flavopiridol, flezelastine, floxuridine, fluasterone, fludarabine, fludarabine (2-F-ara-AMP), fludarabine phosphate, fluorodaunorunicin hydrochloride, fluorouracil, flurocitabine, forfenimex, formestane, fosquidone, fostriecin, fostriecin sodium, fotemustine, gadolinium texaphyrin, gallium nitrate, galocitabine, ganirelix, gelatinase inhibitors, gemcitabine, gemcitabine hydrochloride, glutathione inhibitors, gold au 198, hepsulfam, heregulin, hexamethylene bisacetamide, homocamptothecin, homoharringtonine (HHT), hPRL-G129R, hydroxyurea, hypericin, hypoxanthine, ibandronic acid, idarubicin, idarubicin hydrochloride, idoxifene, idramantone, ifepristone, ifosfamide, ilmofosine, ilomastat, imidazoacridones, imiquimod, immunostimulant peptides, insulin-like growth factor-1 receptor inhibitor, interferon agonists, interferon alfa-2a, interferon alfa-2b, interferon alfa-n3, interferon alfa-nl, interferon beta-i a, interferon gamma-i b, interferons, interleukins, iobenguane, iododoxorubicin, ipomeanol, 4-, iproplatin, irinotecan, irinotecan hydrochloride, iroplact, irsogladine, isobengazole, isohomohalicondrin B, itasetron, jasplakinolide, JM216, JM335, kahalalide F, lamellarin-N triacetate, lanreotide, lanreotide acetate, leinamycin, lenograstim, lentinan sulfate, leptolstatin, letrozole, leukemia inhibiting factor, leukocyte alpha interferon, leuprolide+estrogen+progesterone, leuprolide acetate, leuprorelin, levamisole, liarozole, liarozole hydrochloride, linear polyamine analogue, linomide, lipophilic disaccharide peptide, lipophilic platinum compounds, lissoclinamide 7, lobaplatin, lombricine, lometrexol, lometrexol sodium, lomustine, lonidamine, losoxantrone, losoxantrone hydrochloride, lovastatin, loxoribine, lurtotecan, lutetium texaphyrin, lysofylline, lytic peptides, mannostatin A, marimastat, masoprocol, maspin, matrilysin inhibitors, matrix metalloproteinase inhibitors, maytansine, mechlorethamine hydrochloride, megestrol acetate, melengestrol acetate, melphalan, menogaril, mercaptopurine, meterelin, methioninase, methotrexate, methotrexate sodium, metoclopramide, metoprine, meturedepa, MIF inhibitor, miltefosine, mirimostim, mismatched double stranded RNA, mithracin, mitindomide, mitocarcin, mitocromin, mitogillin, mitoguazone, mitolactol, mitomalcin, mitomycin, mitomycin analogues, mitomycin C, mitonafide, mitosper, mitotane, mitotoxin fibroblast growth factor-saporin, mitoxantrone, mitoxantrone hydrochloride, mitozolomide, mofarotene, molgramostim, monoclonal antibody, human chorionic gonadotrophin, monophosphoryl lipid A+myobacterium cell wall sk, mopidamol, multiple drug resistance gene inhibitor, multiple tumor suppressor 1-based therapy, mustard anticancer agent, mycaperoxide B, mycobacterial cell wall extract, mycophenolic acid, myriaporone, N-(4-hydroxyphenyl) retinamide, N-(2-chloroethyl)-N'-(diethyl) ethylphosphonate-N-nitrosourea (fotemustine), N-(2-chloroethyl)-N'-(trans-4-methylcyclohexyl-N-nitrosourea (MeCCNU), N-(2-chloroethyl)-N' cyclohexyl-N-nitrosourea (CCNU), N, N'-Bis (2-chloroethyl)-N-nitrosourea (BCNU), N-acetyldinaline, nafarelin, nagrestip, naloxone+pentazocine, napavin, naphterpin, nartograstim, nedaplatin, nemorubicin, neridronic acid, neutral endopeptidase, nilutamide, nisamycin, nitric oxide modulators, nitrogen mustard (mechlor ethamine), nitroxide antioxidant, nitrullyn, N-methyl-Nnitrosourea (MNU), nocodazole, nogalamycin, ormaplatin, N-propargyl-5,8-dideazafolic acid, N-substituted benzamides, octreotide, okicenone, oligonucleotides, onapristone, ondansetron, oracin, oral cytokine inducer, ormaplatin, osaterone, oxaliplatin, oxaliplatin, C1-973, oxaunomycin, oxisuran, paclitaxel, paclitaxel analogues, paclitaxel derivatives, palauamine, palmitoylrhizoxin, pamidronic acid, panaxytriol, panomifene, parabactin, pazelliptine, pegaspargase, peldesine, peliomycin, pentamustine, pentosan polysulfate sodium, pentostatin, pentrozole, peploycinsulfate, perflubron, perfosfamide, perillyl alcohol, phenazinomycin, phenylacetate, phosphatase inhibitors, picibanil, pilocarpine hydrochloride, pipobroman, piposulfan, pirarubicin, piritrexim, piroxantrone hydrochloride, placetin A, placetin B, plasminogen activator inhibitor, platinum complex, platinum compounds, platinum-triamine complex, plicamycin, plomestane, podophyllotoxin, porfimer sodium, porfiromycin, prednimustine, procarbazine hydrochloride, propyl bis-acridone, prostaglandin J2, proteasome inhibitors, protein A-based immune modulator, protein kinase C inhibitor, protein kinase C inhibitors, microalgal, protein tyrosine phosphatase inhibitors, purine nucleoside phosphorylase inhibitors, puromycin, puromycin hydrochloride, purpurins, pyrazofurin, pyrazoloacridine, pyridoxylated hemoglobin polyoxyethylene conjugate, raf antagonists, raltitrexed, ramosetron, ras farnesyl protein transferase inhibitors, ras inhibitors, ras-GAP inhibitor, retelliptine demethylated, rhenium Re 186 etidronate, rhizoxin, rhizoxin d, riboprine, ribozymes, RII retinamide, rnerbarone, rogletimide, rohitukine, romurtide, roquinimex, rubiginone B 1, ruboxyl, safingol, safingol hydrochloride, saintopin, SarCNU, sarcophytol A, sargramostim, Sdi 1 mimetics, semustine, senescence derived inhibitor 1, sense oligonucleotides, signal transduction inhibitors, signal transduction modulators, simtrazene, single chain antigen binding protein, sizofiran, sobuzoxane, sodium borocaptate, sodium phenylacetate, solverol, somatomedin binding protein, sonermin, sparfosate sodium, sparfosic acid, sparsomycin, spicamycin D, spirogermanium hydrochloride, spiromustine, spiroplatin, splenopentin, spongistatin 1, squalamine, stem cell inhibitor, stem-cell division inhibitors, stipiamide, streptonigrin, streptozocin, streptozotocin, stromelysin inhibitors, strontium chloride sr 89, sulfinosine, sulfur mustard, sulofenur, superactive vasoactive intestinal peptide antagonist, suradista, suramin, swainsonine, synthetic glycosaminoglycans, talisomycin, tallimustine, tamoxifen methiodide, tauromustine, taxane, taxoid, tazarotene, tecogalan sodium, tegafur, tellurapyrylium, telomerase inhibitors, teloxantrone hydrochloride, temoporfin, temozolomide, teniposide, teniposide 9-amino camptothecin, teroxirone, testolactone, tetrachlorodecaoxide, tetrazomine, thaliblastine, thalidomide, thiamiprine, thiocoraline, thioguanine, thiotepa, thrombopoietin, thrombopoietin mimetic, thymalfasin, thymitaq, thymopoietin receptor agonist, thymotrinan, thyroid stimulating hormone, tiazofurin, tin ethyl etiopurpurin, tirapazamine, titanocene dichloride, tomudex, top53, topotecan, topotecan hydrochloride, topsentin, toremifene, toremifene citrate, totipotent stem cell factor, translation inhibitors, trestolone acetate, tretinoin, triacetyluridine, trichostatin A, triciribine, triciribine phosphate, trimetrexate, trimetrexate glucuronate, triptorelin, tropisetron, tubulozole hydrochloride, turosteride, tyrosine kinase inhibitors, tyrphostins, UBC inhibitors, ubenimex, uracil mustard, uredepa, urogenital sinus-derived growth inhibitory factor, urokinase receptor antagonists, vapreotide, variolin B, vector system, erythrocyte gene therapy, velaresol, veramine, verdins, verteporf in, vinblastine, vinblastine sulfate, vincristine, vincristine sulfate, vindesine, vindesine sulfate, vinepidine sulfate, vinglycinate sulfate, vinleurosine sulfate, vinorelbine, vinorelbine tartrate, vinrosidine sulfate, vinxaltine, vinzolidine sulfate, vitaxin, vorozole, vorozole, zanoterone, zeniplatin, zilascorb, zinostatin, zinostatin stimalamer, and zorubicin hydrochloride.

Immunotherapy agents used in a cancer immunotherapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. For example, immunological target 4-1BB ligand may be targeted with an anti-4-1BB ligand antibody; immunological target OX40L may be targeted with an anti-OX40L antibody; immunological target GITR may be targeted with an anti-GITR antibody; immunological target CD27 may be targeted with an anti-CD27 antibody; immunological target TL1 Å may be targeted with an anti-TL1 Å antibody; immunological target CD40L may be targeted with an anti-CD40L antibody; immunological target LIGHT may be targeted with an anti-LIGHT antibody; immunological target BTLA may be targeted with an anti-BTLA antibody; immunological target LAG3 may be targeted with an anti-LAG3 antibody; immunological target TIM3 may be targeted with an anti-TIM3 antibody; immunological target Singlecs may be targeted with an anti-Singlecs antibody; immunological target ICOS ligand may be targeted with an anti-ICOS ligand antibody; immunological target B7-H3 may be targeted with an anti-B7-H3 antibody; immunological target B7-H4 may be targeted with an anti-B7-H4 antibody; immunological target VISTA may be targeted with an anti-VISTA antibody; immunological target TMIGD2 may be targeted with an anti-TMIGD2 antibody; immunological target BTNL2 may be targeted with an anti-BTNL2 antibody; immunological target CD48 may be targeted with an anti-CD48 antibody; immunological target KIR may be targeted with an anti-KIR antibody; immunological target LIR may be targeted with an anti-LIR antibody; immunological target ILT may be targeted with an anti-ILT antibody; immunological target NKG2D may be targeted with an anti-NKG2D antibody; immunological target NKG2A may be targeted with an anti-NKG2A antibody; immunological target MICA may be targeted with an anti-MICA antibody; immunological target MICB may be targeted with an anti-MICB antibody; immunological target CD244 may be targeted with an anti-CD244 antibody; immunological target CSF1R may be targeted with an anti-CSF1R antibody; immunological target IDO may be targeted with an anti-IDO antibody; immunological target TGFβ may be targeted with an anti-TGFβ antibody; immunological target CD39 may be targeted with an anti-CD39 antibody; immunological target CD73 may be targeted with an anti-CD73 antibody; immunological target CXCR4 may be targeted with an anti-CXCR4 antibody; immunological target CXCL12 may be targeted with an anti-CXCL12 antibody; immunological target SIRPA may be targeted with an anti-SIRPA antibody; immunological target CD47 may be targeted with an anti-CD47 antibody; immunological target VEGF may be targeted with an anti-VEGF antibody; and immunological target neuropilin may be targeted with an anti-neuropilin antibody (see, e.g., Table 1 of Mahoney et al.).

In some embodiments, the pharmaceutical compositions of the invention may be used in combination with a cancer radiation therapy. In some embodiments, a cancer radiation therapy includes the use of directed gamma rays or beta rays to induce sufficient damage to a cell so as to limit its ability to function normally or to destroy the cell altogether.

The cancers amendable to treatment according to the invention include, but are not limited to, bladder cancer, pancreatic cancer, cervical cancer, lung cancer, liver cancer, ovarian cancer, colon cancer, stomach cancer, virally induced cancer, neuroblastoma, breast cancer, prostate cancer, renal cancer, leukemia, sarcomas, carcinomas, oral squamous cell carcinoma, non-small cell lung carcinoma, non-Hodgkin's lymphoma, and, e.g., those described in Table 1 of Falschlehner et al, Adv Exp Med Biol. 647:195-206, 2009, which is incorporated herein by reference in its entirety. In some embodiments, cancerous conditions amendable to treatment according to the invention include metastatic cancers. Preferably, the pharmaceutical compositions of the invention contain one or more TNFSF or TNF-like ligand muteins that are present in a disulfide-bonded homo-multimeric (e.g., homo-trimeric) complex.

In particular, TRAIL muteins of the invention may be used in cancer therapy (e.g., a cancer combination therapy with a chemotherapy agent, an immunotherapy agent, or radiation), such as in the treatment of solid tumors (e.g., those described in Falschlehner et al, Adv Exp Med Biol. 647:195-206, 2009, which is incorporated herein by reference in its entirety). Tumor cells that may be treated with TRAIL muteins of the invention include, e.g., non-small cell lung carcinoma, non-Hodgkin's lymphoma erythroleukemic cells, acute myeloid leukemia (AML), soft tissue sarcoma, melanoma (see, e.g., Table 1 of Falschlehner et al.). In some embodiments, TRAIL muteins of the invention may be used in combination with one or more chemotherapy agents (see, e.g., Tables 1, 2, and 3 of Falschlehner et al.) in cancer therapy (e.g., chemotherapy) (e.g., in the treatment of solid tumors (e.g., advanced solid tumors)). Chemotherapy agents used in a cancer chemotherapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus.

In some embodiments, TRAIL muteins of the invention may be used in combination with one or more immunotherapy agents in a cancer immunotherapy. Immunotherapy agents used in a cancer immunotherapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TRAIL cross-linking agent, a CD27 agent, a CD30 agent, a CD40 agent, a 4-1 BB agent, a GITR agent, an OX40 agent, a TRAILR1 agent, a TRAILR2 agent, a TWEAKR agent, and, e.g., agents directed toward the immunological targets described in Table 1 of Mahoney et al. Examples of agents directed toward the immunological targets described in Table 1 of Mahoney et al are described previously.

In some embodiments, TRAIL muteins of the invention may be used in combination with a cancer radiation therapy. In some embodiments, a cancer radiation therapy includes the use of directed gamma rays or beta rays to induce sufficient damage to a cell so as to limit its ability to function normally or to destroy the cell altogether.

The pharmaceutical compositions of the invention may be used in the treatment of infectious diseases, e.g., hepatitis B, hepatitis C, acquired immunodeficiency syndrome (AIDS), leprosy, and tuberculosis (TB). Preferably, the pharmaceutical compositions of the invention contain one or more TNFSF or TNF-like ligand muteins. In one embodiment, the TNFSF ligand mutein is a TNF-α mutein (e.g., a S171C/G224C TNF-α mutein) that is present in a disulfide-bonded homo-trimeric complex.

For patients who are undergoing or have undergone organ transplantation, or tissue or organ repair or regeneration, pharmaceutical compositions containing TNFSF or TNF-like ligand muteins of the invention may be administered to the patient (e.g., by injection into the patient's bloodstream or directly into or near the tissue or organ or site of transplantation). Preferably, the pharmaceutical compositions contain one or more TNFSF ligand muteins (e.g., TNFSF ligand muteins that are present in a disulfide-bonded homo-multimeric (e.g., homo-trimeric) complex). In one embodiment, the TNFSF ligand mutein is a TNF-α mutein (e.g., a S171C/G224C TNF-α mutein) that is present in a disulfide-bonded homo-trimeric complex. Examples of transplant patients are those that are receiving or have received a heart, heart valve, blood vessel (e.g., artery or vein), kidney, liver, lung, or lung lobe, pancreas, ovary, bladder, stomach, testis, intestine, thymus, bone, tendon, cornea, skin, nerve, hand, arm, foot, leg, or cellular (e.g., beta-islet cells, stem cells (e.g., hematopoietic stem cells, such as bone marrow stem cells (e.g., CD34+ stem cells))) transplant. The transplant patient may also have received an autologous, allogeneic, or syngeneic cell transplant. The administration of a pharmaceutical composition containing a covalently cross-linked multimer of a TNFSF ligand mutein, e.g., a covalently cross-linked TNF-α mutein homo-trimer, may help to reduce or eliminate the risk of cell, tissue, or organ rejection, e.g., graft-versus-host disease (GVHD) and graft rejection, and to provide better engraftment of the transplanted cell, tissue, or organ.

In other preferred embodiments, a disulfide-bonded homo-trimeric TNF-α mutein complex containing three TNF-α muteins (e.g., a complex in which each monomer contains S171C and G224C substitutions) may be used to repair or regenerate an organ or tissue (e.g., in an autoimmune disease patient in which the organ or tissue is targeted by autoreactive CD8+× T cells). Administration of the TNF-α homo-trimer kills the autoreactive CD8+ T cells, which allows the organ or tissue to regenerate. In an embodiment, the TNF-α mutein homo-trimer may be administered in a combination therapy, which includes co-administration (either together or separate) of pluripotent cells (e.g., MSCs, HSCs, or Hox11 cells (see, e.g., U.S. Pat. Nos. 8,017,392 and 8,021,693, each of which is incorporated herein by reference in its entirety). In some embodiments, administration of the TNF-α mutein complex can be used to repair or regenerate an organ or tissue selected from the group consisting of a heart, heart valve, blood vessel (e.g., artery or vein), kidney, liver, lung, or lung lobe, pancreas, ovary, bladder, stomach, testis, intestine, thymus, bone, tendon, cornea, skin, nerve, hand, arm, foot, and leg. In other embodiments, administration of the TNF-α mutein complex can also be used in patients who are receiving or have received cellular (e.g., beta-islet cells, stem cells (e.g., hematopoietic stem cells, such as bone marrow stem cells (e.g., CD34+ stem cells))) transplant.

Table 3 lists exemplary diseases and disorders that may be treated with each TNFSF or TNF-like mutein of the invention.

TABLE 3

| TNFSF or TNF-like ligand mutein | Diseases and Disorders |
| --- | --- |
| TNF-α mutein | type 1 diabetes, Sjögren's Syndrome, multiple sclerosis, inflammatory bowel disease, rheumatoid arthritis, diseases related to miscarriage, and cancers |
| LT-α mutein | T cell lymphoma, vitiligo, non-Hodgkin's lymphoma, psoriatic arthritis, and leprosy |
| LT-β mutein | type 1 diabetes, rheumatoid arthritis, and cancers |
| OX40L mutein | chronic hepatitis C infection, lupus, atherosclerosis, allograft rejection, type 1 diabetes, and asthma |
| CD40L mutein | Sjögren's Syndrome, allergies, atherosclerosis, breast cancer, and type 1 diabetes |
| FasL (Fas ligand) mutein | autoimmune lymphoproliferative syndrome (ALPS), oral squamous cell carcinoma, neuroblastoma, rheumatoid arthritis, and cancers |
| CD70 mutein | rheumatoidarthritis, contact dermatitis, asthma, GVHD, psoriasis, and oral cancer (e.g., oral squamous cell carcinoma) |
| CD153 mutein | atherosclerosis, rheumatoid arthritis, ovarian cancer, tuberculosis (TB), asthma, and GVHD |
| 4-1BB ligand mutein | autoimmune diseases (e.g., multiple sclerosis), asthma, and GVHD |
| TRAIL mutein | cancers, solid tumor cancers (e.g., breast cancer, pancreatic cancer, brain cancer, and colon cancer), autoimmune diseases (e.g., multiple sclerosis), and inflammation |
| RANKL mutein | diseases related to bone loss, periodontal disease, hypercalcemia, pain, transplantations (e.g., cell, tissue, and organ), cancers, infectious diseases, autoimmune diseases, and those described in Hofbauer et al. (Cancer 92:460-470, 2001), Suda et al. (Endocr Rev. 20:345-357, 1999), and U.S. Pat. No. 7,399,829 |

TABLE 3-continued

| TNFSF or TNF-like ligand mutein | Diseases and Disorders |
| --- | --- |
| TWEAK mutein | tissue repair and remodeling |
| APRIL mutein | B cell maturation and reconstitution |
| BLys mutein | B cell maturation and reconstitution |
| LIGHT mutein | cancer |
| TL1 mutein | cancer |
| GITRL (also known as TL6) mutein | cancer |
| EDA mutein (e.g., EDA-A1, EDA-A2) mutein | cancer |
| Adiponectin mutein | cancer, type 2 diabetes, and atherosclerosis |

EXAMPLES

Example 1—Materials and Methods

Reagents

Recombinant human and mouse TNF-α was purchased from Leinco Technologies (St. Louis, Mo.), and recombinant human IL-2 was purchased from Sigma-Aldrich (St. Louis, Mo.). Human monoclonal antibodies against TNFR2 were from internal sources and external commercial vendors. Intracellular staining of FOXP3 and CD25 were performed using either FOXP3 Fix/Perm Buffer set (Biolegend) or Human FOXP3 Buffer set (BD Biosciences).

Human Subjects

Subjects used in this study were either Type-1 diabetic subjects or non-affected control subjects. They were recruited from Massachusetts General Hospital with full institutional approval and informed consent (MGH-2001 P001379). Each subject donated 4 tubes of blood and the blood was used fresh in the morning for the preparation of either CD8 T cells for the WST-1 proliferation/death assay or CD4 T cells for the T regulatory assays. For the WST-1 assays of cell proliferation or death, each autoimmune subject was simultaneously studied with a control subject. All blood was drawn into BD Vacutainer tubes containing acid citrate and dextrose.

Blood Preparation

Purified CD4 or CD8 T cell subsets were isolated from peripheral blood lymphocytes were isolated using Dynal magnetic isolation methods (Invitrogen Product Nos 113-33D and 113-31D). This method yielded fresh human CD4 or CD8 T cells that were over 95% viable. PBLs were isolated with Ficoll-Hypque gradients.

Example 2—Construction of Wild-Type Soluble TNF-α and the TNF-α Mutein

In this example, the wild-type soluble TNF-α is a TNF-α monomer and the TNF-α mutein is a disulfide-bonded homo-trimer of TNF-α muteins in which each monomer contains S171C and G224C cysteine substitutions. Construction of wild-type soluble TNF-α and the TNF-α mutein involved original gene synthesis of the DNA fragments into the His6-thrombin-site-TNF-α gene-fusion and these were subcloned into pDEST42 expression vector. Positive clones were confirmed by restriction enzyme digestion and sequence validation. Wild-type soluble TNF-α and the TNF-α mutein were expressed in E. coli strain BL21 DE3 pLys S using the following conditions: a seed culture was incubated at 37° C. for 16 hours and was used to inoculate 4 liter of tissue culture media, which was incubated at 37°

C. until A600=0.8. Protein expression was induced with IPTG (0.1 mM) for 16 hours at 18° C. Cells were harvested by centrifugation and stored at −80° C.

Cell paste was suspended in Buffer A (20 mM Tris, pH 7.9, 500 mM NaCl, 5 mM imidazole, 0.01% NP-40) and lysed using a PANDA homogenizer. The lysate was clarified by centrifugation and the supernatant was applied to a 5-ml Ni-NTA sepharose column (Qiagen) using a AKTA Explorer (GE Heathcare). The column was washed with 10 column columns Buffer A and the bound protein was eluted with a linear gradient of 0-100% Buffer B collecting 5 ml fractions. Aliquots of protein containing fractions were mixed with SDS-sample buffer and electrophoresed under reducing conditions on 4-20% gels. Gels were stained with Coomassie Brilliant Blue (R-25). Anti-his antibodies (Clontech) were used for Western blot analysis.

The N-terminal polyhistidine-tag was cleaved using a thrombin cleavage capture kit (Novagen, Cat #69022-3) following the manufacturer's protocol. Biotinylated thrombin was removed from the protein prep using streptavidin agarose following the manufacturer's protocol.

Protein concentration was determined by Bradford's method. Final pool of protein was buffer-exchanged into 1×PBS, 0.1% albumin (pH 7.4) snap frozen in 0.5 ml aliquot and stored at −80° C. Final protein prep was subjected to N-terminal sequencing to confirm protein identity and correct His-tag removal.

Example 3—Western Blot Analysis of the TNF-α Mutein

In this example, the wild-type soluble TNF-α is a TNF-α monomer and the TNF mutein is a disulfide-bonded homotrimer of TNF-α muteins in which each monomer contains S171C and G224C cysteine substitutions. Wild-type soluble TNF-α and TNF-α mutein were analyzed on a Peggy Automated Western Assay Platform in size separation mode (ProteinSimple, Santa Clara, Calif.). Samples (0.5 µg/ul) were mixed at a ratio of 3:1 with a 4× Mastermix containing fluorescent molecular weight standards and sample buffer, but without DTT (Dithiothreitol) reducing agent. To further prevent reduction, the samples were not subjected to high (95° C.) temperature as is customary, but rather were kept on ice until use. All running parameters were left at their defaults, except for loading time (12 seconds instead of default of 8 seconds) and for first antibody incubation time (240 min instead of default of 120 min). Detection of wild-type soluble TNF-α and the TNF-α mutein was performed with a monoclonal antibody to human TNF (Abcam ab8348, Cambridge, Mass.) followed by HRP-labeled second antibody and Luminol/$H_2O_2$.

Figure 2A:
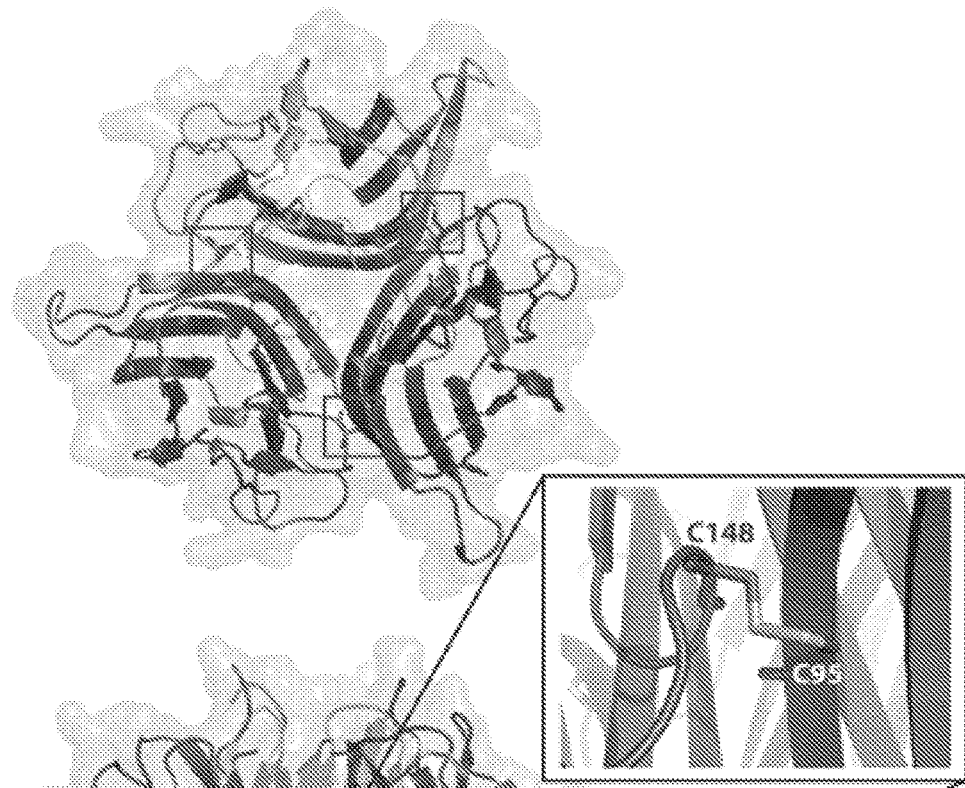
FIGS. 2A and 2B show a 3D model of a homo-trimeric TNF-α mutein composed of covalently cross-linked TNF-α monomers.
Figure 2B:
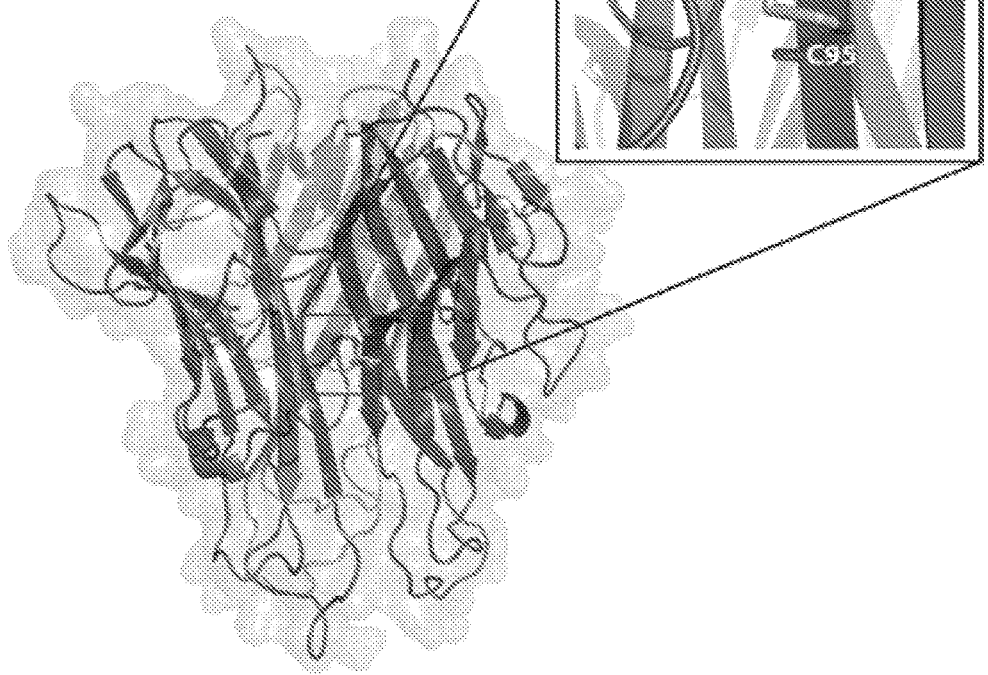

Western blot analysis showed that the TNF-α mutein is a stable covalent trimer compared to wild-type soluble TNF-α which appeared as a monomer (FIG. 2).

Example 4—Functional Studies of Wild-Type Soluble TNF-α or TNF-α Mutein on Human CD4 T Cells In this example, wild-type soluble TNF-α refers to a non-covalently cross-linked homo-trimer of wild-type soluble TNF-α and TNF mutein refers to a covalently cross-linked homo-trimer of TNF-α monomers, with each monomer containing S171C and G224C cysteine substitutions.

Isolated fresh human CD4 T cells treated with selective TNFR2 agonism proliferate and expand into abundant human T-regulatory (Treg) cells defined by the co-expression of CD25 and high density FOXP3 intracellular protein. CD4 T cells were isolated from fresh human blood within 2 hours of venipuncture using Dynal CD4 Positive Isolation Kit (Invitrogen). We cultured freshly isolated human CD4 cells with only IL-2, or IL-2 plus wild-type soluble TNF-α. We modified the protocol recommended by the manufacturer by using HBSS supplemented with 2% fetal bovine serum (FBS) (Hyclone, Logan, Utah) instead of PBS. To verify the quality of isolated cells, they were assessed to be greater than 98% in purity and 96% in viability by CD4 and propidium iodide staining. After isolation, $2 \times 10^5$ cells were plated in 96 round-bottom well and treated with IL-2 (50 U/ml) alone, IL-2 (50 U/ml) and wild-type soluble TNF-α (20 ng/ml), IL-2 (50 U/ml) and TNF-α mutein (20 ng/ml), or a TNFR2 antagonist antibody from the Immunobiology Core (Harvard Medical School, Boston, Mass.). After 16 hours, cells were collected and intracellular FOXP3 was determined by flow cytometry.

Figure 3A:
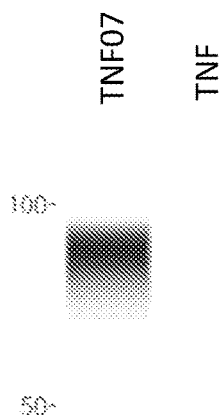
FIGS. 3A, 3B, and 3C show the molecular and functional traits of the TNF-α mutein ("TNF07", a covalently cross-linked, homo-trimeric TNF-α mutein) compared to wild-type soluble TNF-α (non-covalently cross-linked, homo-trimeric TNF-α) on gels, in CD4 T-regulatory expansion assays, and as proliferative agents on human CD8 T cells or killing agents on autoreactive diabetic T cells.
Figure 3B:
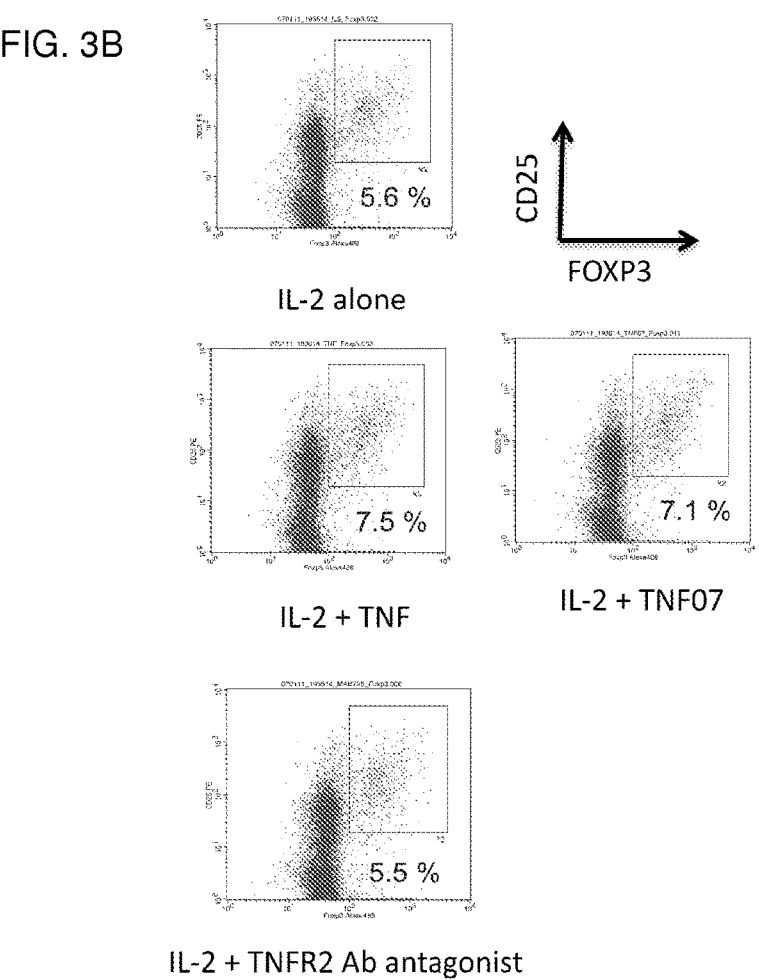

As the data in FIG. 3B show, treatment with IL-2 and wild-type soluble TNF-α after 16 hours induced FOXP3 expression to a greater degree than IL-2 alone. Co-incubation of isolated CD4 T cells with IL-2 and the TNF-α mutein also expanded T regulatory cells. In marked contrast, CD4 T cells incubated for 16 hours with 1L2 and a well-known TNFR2 antibody antagonist showed an opposite effect. The antagonist antibody to TNFR2 turned off Treg expansion compared to IL-2, IL-2 and wild-type soluble TNF-α, or IL-2 and TNF-α mutein. Representative flow histogram is shown in FIG. 3B. The data in total included 6 normal subjects who yielded similar expansion and enhanced expression of FOXP3 Treg cells with the TNF-α mutein.

Example 5—Functional Studies of Wild-Type Soluble TNF-α or TNF-α Mutein Signaling on Human CD8 T Cells In this example, wild-type soluble TNF-α refers to a non-covalently cross-linked homo-trimer of wild-type soluble TNF-α and TNF mutein refers to a covalently cross-linked homo-trimer of TNF-α monomers, with each monomer containing S171C and G224C cysteine substitutions.

Figure 3C:
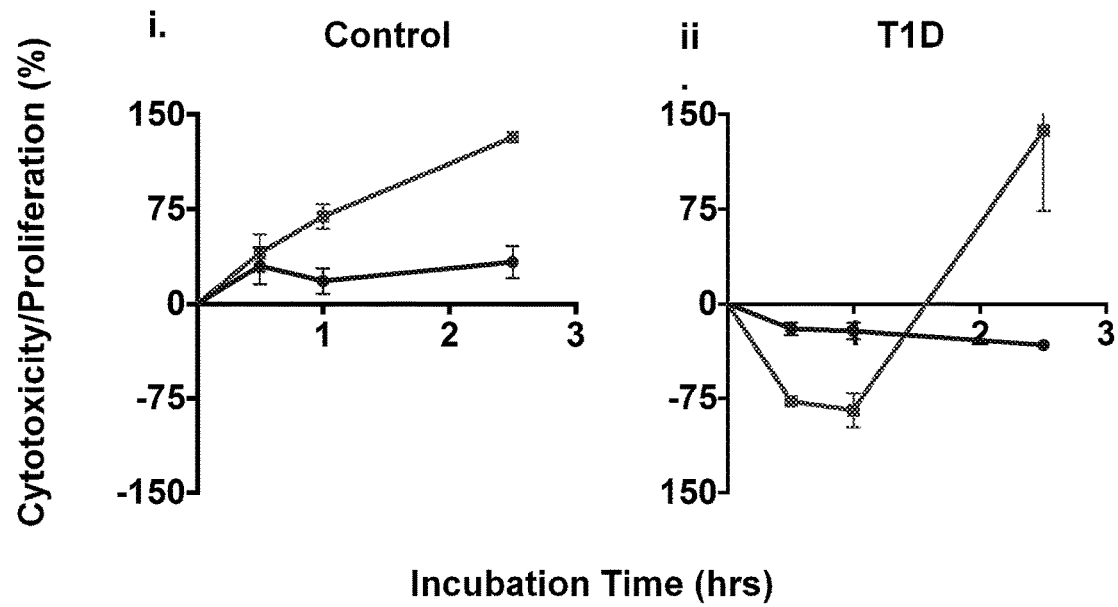

Fresh human CD8 T cells from normal donors are known to proliferate when incubated with wild-type soluble TNF-α or incubated with TNFR2 agonists through activation of the NFkB pathway. FIG. 3C (i) shows that both wild-type soluble TNF-α and the TNF-α mutein induced CD8 cell proliferation in a dose-response manner in a proliferation and cell death assay. The CD8 cells were collected from a group of 10 normal donors. The TNF-α mutein performed in a superior manner to wild-type soluble TNF-α. Fresh human CD8 T cells from Type-1 diabetic subjects contain a minor subpopulation of autoreactive CD8 T cells that can be selectively killed with low dose TNF-α. FIG. 3C (ii) shows that both wild-type soluble TNF-α and the TNF-α mutein first induced cell death of the sensitive autoreactive CD8 T cells and then induced proliferation of the remaining CD8 T cells from diabetic subjects. The CD8 cells were collected from a group of 6 diabetic subjects. Similar to the previous proliferation response of normal CD8 T cells, the TNF-α mutein was more potent than wild-type soluble TNF-α, an effect attributable to greater TNFR2 agonism than wild-type soluble TNF-α alone.

The WST-1 (Roche Applied Science) assay was used to confirm cell death versus proliferation after the addition of wild-type soluble TNF-α or the TNF-α mutein on isolated fresh human CD8 T cells from normal controls or Type-1 diabetic subjects. The WST-1 assay is a cell proliferation assay that indirectly measures cell death. In a WST-1 assay, the isolated CD8 T cells were plated into 96 well U-bottom plate with a cell concentration of 100,000 cells/well. Cells were cultured overnight at 26° C. in RPMI media with 1% heat inactivated fetal calf serum (FCS). In the morning, the cells were treated with wild-type soluble TNF-α or the TNF-α mutein for 1 hour. After the 1-hour exposure to wild-type soluble TNF-α or the TNF-α mutein, the WST-1 reagent (44-[3-(4-iodophenyl)-2-(4-nitrophenyl) 2H-5-tetrazolio]-1,3-benzendisulfonate) was added according to the manufacturer's instructions. The cleavage of WST-1 to fromazan by metabolically active cells was quantified by Beckman Coulter DTX 880 Spectrophotometer (Beckman Coulter) at a wavelength 405 m. Each experiment was performed in triplicate. Test medium was used as background control. The cells treated with various doses of ligand are presented as a percentage of proliferation compared to the untreated cells using the following equation: [wild-type TNF or TNF mutein treated—untreated]/[untreated]. A negative number means there was greater cell death compared to proliferation of the mixed cell populations of CD8 T cells.

We have shown that the TNF-α mutein can generate not only a stable trimer, but one with improved functional consequences on human CD4 or CD8 T cells. The results of the human functional T cell assays indicate that TNF-α mutein is a powerful transmembrane TNF-like analogue with TNFR2 agonism. The TNF-α mutein not only induced the selective death of autoreactive CD8 T cells and the proliferation of normal CD8 T cells in Type-1 diabetic patients, but also expanded CD4 Treg cells. The TNF-α mutein also seems superior over a single-chain construct of soluble TNF (sc-TNF) that, while showing better binding to both TNFR1 and TNFR2, did not show TNFR2 agonism. Various defects in TNF signaling pathways occur in both human and mouse models of several autoimmune disorders, including Crohn's disease, Sjögren's syndrome, multiple sclerosis, ankylosing spondylitis, and Type 1 diabetes. Soluble TNF, TNF inducers, and TNFR2 agonism have shown promise for treating these diseases. Due to the more limited expression of TNFR2, TNFR2 agonism provides a potentially more targeted therapy with fewer side effects. The TNF-α mutein could be combined with additional mutations to introduce receptor specificity. A TNFR2-specific sc-TNF variant has recently been shown to rescue human neurons from oxidative cell death highlighting the potential application of TNF analogues in neurodegenerative diseases (Fischer et al., *PloS One* 6:e27621, 2011). Finally, the high structural homology within the TNFSF and TNF-like ligands provides an opportunity to extend the covalent cross-linking concept to other TNF superfamily members and TNF-like structures. Different methods of external secondary cross-linking have already been shown to improve signaling for FasL, TRAIL, CD40L, 4-1BBL and others (Bremer et al., *ISRN Oncology* 2013:371854, 2013).

Example 6—Treatment of Solid Tumors by a TRAIL Mutein

A patient may be treated with a TRAIL mutein of the invention for cancer, such as a solid tumor cancer. Various treatments of solid tumor cancers using TRAIL are described in Falschlehner et al, *Adv Exp Med Biol.* 647:195-206, 2009, which is incorporated herein by reference in its entirety. Tumor cells that may be treated with TRAIL muteins of the invention include, e.g., non-small cell lung carcinoma, non-Hodgkin's lymphoma erythroleukemic cells, acute myeloid leukemia (AML), soft tissue sarcoma, melanoma (see, e.g., Table 1 of Falschlehner et al.). In some embodiments, TRAIL muteins of the invention may be used in combination with one or more chemotherapy agents (see, e.g., Tables 1, 2, and 3 of Falschlehner et al.) in cancer therapy (e.g., a chemotherapy) (e.g., in the treatment of solid tumors (e.g., advanced solid tumors)). Chemotherapy agents used in a cancer chemotherapy may include, but are not limited to, camptothecin, cisplatin, carboplatin, oxaliplatin, bleomycin, mitomycin C, calicheamicins, maytansinoids, geldanamycin, doxorubicin, idarubicin, daunorubicin, epirubicin, busulfan, carmustine (BCNU), lomustine (CCNU), semustine, thalidomide, lenalidomide, methotrexate, azathioprine, 6-mercaptopurine, fludarabine, 5-azacytidine, pentostatin (2'-deoxycoformycin), cytarabine (cytosine arabinoside), gemcitabine, 5-fluorouracil, hydroxyurea, elesclomol, etoposide, teniposide, amsacrine, topotecan, irinotecan, chlorambucil, cyclophosphamide, ifosfamide, melphalan, bortezomib, vincristine, vinblastine, vinorelbine, paclitaxel, docetaxel, amphotericin B, rifampicin, pentamidine, cyclosporine A, tacrolimus (FK506), sirolimus (rapamycin), everolimus, temsirolimus, zotarolimus, and biolimus.

In some embodiments, TRAIL muteins of the invention may be used in combination with one or more immunotherapy agents in a cancer immunotherapy. Immunotherapy agents used in a cancer immunotherapy may include, but are not limited to, an anti-TNF receptor superfamily agonist antibody, an anti-TNF receptor superfamily antagonist antibody, cancer checkpoint inhibitors such as an anti-CTLA-4 agent, an anti-PD-1 agent, an anti-PD-L1 agent, and an anti-PD-L2 agent, a TRAIL cross-linking agent, a CD27 agent, a CD30 agent, a CD40 agent, a 4-1BB agent, a GITR agent, an OX40 agent, a TRAILR1 agent, a TRAILR2 agent, a TWEAKR agent, and, e.g., agents directed toward the immunological targets described in Table 1 of Mahoney et al. Examples of agents directed toward the immunological targets described in Table 1 of Mahoney et al are described previously.

In some embodiments, TRAIL muteins of the invention may be used in combination with a cancer radiation therapy. In some embodiments, a cancer radiation therapy includes the use of directed gamma rays or beta rays to induce sufficient damage to a cell so as to limit its ability to function normally or to destroy the cell altogether.

A unit dose containing 0.2 to about 20 mg per kg of body weight of a purified TRAIL mutein may be administered to a patient via an appropriate route of administration (e.g., intravenously or orally) one or more times (e.g., 1-10 times or more) daily, weekly, monthly, biannually, annually, or as medically necessary. When used in a co-therapy with one or more chemotherapy agents or the immunotherapy agents, the TRAIL mutein may be administered before, after, or at the same time as the chemotherapy agents or the immunotherapy agents. The timing between administrations may decrease as the medical condition improves or increase as the health of the patient declines.

To monitor the response of the patients to the specific pharmaceutical composition and treatment regimen used, blood samples may be obtained from the patients to be assayed for various biomarkers indicative of the disease being treated. These may include the evaluation of a panel of inflammatory cytokines that would be tested in the blood to determine how they may change overtime in response to the TRAIL mutein therapy.

Example 7—Treatment of Autoimmune Diseases
by a TNF-α Mutein

For patients suffering from an autoimmune disease, in particular, insulin dependent (type 1) diabetes, rheumatoid arthritis, Sjögren's syndrome, multiple sclerosis, or Crohn's disease, a pharmaceutical composition containing a disulfide-bonded homo-trimeric TNF-α mutein may be administered to selectively kill autoreactive T cells and/or promote the proliferation of T-regulatory cells. Alternatively, a pharmaceutical composition may contain a nucleic acid molecule encoding a TNF-α mutein (e.g., a disulfide-bonded homo-trimeric TNF-α mutein). The nucleic acid molecule may be cloned into an expression vector, which may be delivered to the patient using well-known methods in gene therapy, such that the TNF-α mutein may express in vivo. The disulfide-bonded homo-trimeric TNF-α mutein contains three TNF-α muteins in which each monomer contains S171C and G224C cysteine substitutions.

A unit dose containing 0.2 to about 20 mg per kg of body weight of purified TNF-α mutein may be administered to a patient via an appropriate route of administration (e.g., intravenously or orally) one or more times (e.g., 1-10 times or more) daily, weekly, monthly, biannually, annually, or as medically necessary. The timing between administrations may decrease as the medical condition improves or increase as the health of the patient declines.

To monitor the response of the patients to the specific pharmaceutical composition and treatment regimen used, blood samples may be obtained from the patients to be assayed for various biomarkers indicative of the disease being treated. These may include the evaluation of a panel of inflammatory cytokines that would be tested in the blood to determine how they may change overtime in response to TNF-α mutein therapy.

Example 8—Treatment of Neurological Diseases
by a TNF-α Mutein

For patients suffering from a neurological disease, in particular, amyotrophic lateral sclerosis (ALS), Parkinson's disease, or Alzheimer's disease, administration of a pharmaceutical composition containing a disulfide-bonded homo-trimeric TNF-α mutein may be administered. Alternatively, a pharmaceutical composition may contain a nucleic acid molecule encoding a TNF-α mutein (e.g., a disulfide-bonded homo-trimeric TNF-α mutein). The nucleic acid molecule may be cloned into an expression vector, which may be delivered to the patient using well-known methods in gene therapy, such that the TNF-α mutein may express in vivo. The disulfide-bonded homo-trimeric TNF-α mutein contains three TNF-α muteins in which each monomer contains S171C and G224C cysteine substitutions. The disulfide-bonded homo-trimeric TNF-α mutein contains three TNF-α muteins in which each monomer contains S171C and G224C cysteine substitutions.

A unit dose containing 0.2 to about 20 mg per kg of body weight of purified TNF-α mutein homo-trimer may be administered to a patient via an appropriate route of administration (e.g., intravenously or orally) one or more times (e.g., 1-10 times or more) daily, weekly, monthly, biannually, annually, or as medically necessary. The timing between administrations may decrease as the medical condition improves or increase as the health of the patient declines.

To monitor the response of the patients to the specific pharmaceutical composition and treatment regimen used, blood samples may be obtained from the patients to be assayed for various biomarkers indicative of the disease being treated. These may include the evaluation of a panel of inflammatory cytokines that would be tested in the blood to determine how they may change overtime in response to TNF-α mutein therapy.

OTHER EMBODIMENTS

All publications, patents, and patent applications mentioned in the above specification are hereby incorporated by reference. Various modifications and variations of the described compositions, methods, and uses of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention that are obvious to those skilled in the art are intended to be within the scope of the invention.

Other embodiments are within the following claims.

SEQUENCE LISTING (735 sequences)

SEQ ID NO: 1 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVACVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 3 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRACALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 4 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVCLLSAIKSPCQRETPEGAEAKPWYEPIYLGGVFQLEKGDRLSAEINRPDYLDFAESGQVYFGIIAL

SEQ ID NO: 5 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNCLSAIKSPCQRETPEGAEAKPWYEPIYLGGVFQLEKGDRLSAEINRPDYLDFAESGQVYFGIIAL

SEQ ID NO: 6 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLCSAIKSPCQRETPEGAEAKPWYEPIYLGGVFQLEKGDRLSAEINRPDYLDFAESGQVYFGIIAL

SEQ ID NO: 7 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLCAIKSPCQRETPEGAEAKPWYEPIYLGGVFQLEKGDRLSAEINRPDYLDFAESGQVYFGIIAL

SEQ ID NO: 8 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSCIKSPCQRETPEGAEAKPWYEPIYLGGVFQLEKGDRLSAEINRPDYLDFAESGQVYFGIIAL

SEQ ID NO: 9 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSACKSPCQRETPEGAEAKPWYEPIYLGGVFQLEKGDRLSAEINRPDYLDFAESGQVYFGIIAL

SEQ ID NO: 10 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAICSPCQRETPEGAEAKPWYEPIYLGGVFQLEKGDRLSAEINRPDYLDFAESGQVYFGIIAL

SEQ ID NO: 11 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKCPCQRETPEGAEAKPWYEPIYLGGVFQLEKGDRLSAEINRPDYLDFAESGQVYFGIIAL

SEQ ID NO: 12 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCCRETPEGAEAKPWYEPIYLGGVFQLEKGDRLSAEINRPDYLDFAESGQVYFGIIAL

SEQ ID NO: 13 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRCTPEGAEAKPWYEPIYLGGVFQLEKGDRLSAEINRPDYLDFAESGQVYFGIIAL

SEQ ID NO: 14 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPCYEPIYLGGVFQLEKGDRLSAEINRPDYLDFAESGQVYFGIIAL

SEQ ID NO: 15 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWCEPIYLGGVFQLEKGDRLSAEINRPDYLDFAESGQVYFGIIAL

SEQ ID NO: 16 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYECIYLGGVFQLEKGDRLSAEINRPDYLDFAESGQVYFGIIAL

SEQ ID NO: 17 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGCFQLEKGDRLSAEINRPDYLDFAESGQVYFGIIAL

SEQ ID NO: 18 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVCQLEKGDRLSAEINRPDYLDFAESGQVYFGIIAL

SEQ ID NO: 19 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAECGQVYFGIIAL

SEQ ID NO: 20 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESCQVYFGIIAL

SEQ ID NO: 21 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGCVYFGIIAL

SEQ ID NO: 22 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVCLLSAIKSPCQRETPEGAEAKPWYEPIYLGGVFQLEKGDRLSAEINRPDYLDFAECGQVYFGIIAL

SEQ ID NO: 23 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVCLLSAIKSPCQRETPEGAEAKPWYEPIYLGGVFQLEKGDRLSAEINRPDYLDFAESCQVYFGIIAL

SEQ ID NO: 24 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNCLSAIKSPCQRETPEGAEAKPWYEPIYLGGVFQLEKGDRLSAEINRPDYLDFAECGQVYFGIIAL

SEQ ID NO: 25 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNCLSAIKSPCQRETPEGAEAKPWYEPIYLGGVFQLEKGDRLSAEINRPDYLDFAESCQVYFGIIAL

SEQ ID NO: 26 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLCSAIKSPCQRETPEGAEAKPWYEPIYLGGVFQLEKGDRLSAEINRPDYLDFAECGQVYFGIIAL

SEQ ID NO: 27 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLCAIKSPCQRETPEGAEAKPWYEPIYLGGVFQLEKGDRLSAEINRPDYLDFAECGQVYFGIIAL

SEQ ID NO: 28 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLCAIKSPCQRETPEGAEAKPWYEPIYLGGVFQLEKGDRLSAEINRPDYLDFAESCQVYFGIIAL

SEQ ID NO: 29 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLCAIKSPCQRETPEGAEAKPWYEPIYLGGVFQLEKGDRLSAEINRPDYLDFAESGCVYFGIIAL

SEQ ID NO: 30 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSCIKSPCQRETPEGAEAKPWYECIYLGGVFQLEKGDRLSAEINRPDYLDFAESGQVYFGIIAL

SEQ ID NO: 31 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSACKSPCQRETPEGAEAKPWCEPIYLGGVFQLEKGDRLSAEINRPDYLDFAESGQVYFGIIAL

SEQ ID NO: 32 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSACKSPCQRETPEGAEAKPWYECIYLGGVFQLEKGDRLSAEINRPDYLDFAESGQVYFGIIAL

SEQ ID NO: 33 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAICSPCQRETPEGAEAKPWCEPIYLGGVFQLEKGDRLSAEINRPDYLDFAESGQVYFGIIAL

SEQ ID NO: 34 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKCPCQRETPEGAEAKPCYEPIYLGGVFQLEKGDRLSAEINRPDYLDFAESGQVYFGIIAL

SEQ ID NO: 35 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKCPCQRETPEGAEAKPWCEPIYLGGVFQLEKGDRLSAEINRPDYLDFAESGQVYFGIIAL

SEQ ID NO: 36 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCCRCTPEGAEAKPWYEPIYLGGVFQLEKGDRLSAEINRPDYLDFAESGQVYFGIIAL

SEQ ID NO: 37 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVACVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGCFQLEKGDRLSAEINRPDYLDFAESGQVYFGIIAL

SEQ ID NO: 38 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVACVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVCQLEKGDRLSAEINRPDYLDFAESGQVYFGIIAL

SEQ ID NO: 39 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRACALLANGVELRDNQLVVPSEGLYLIYSQVLFKGQGCPSTHVLLTHTISRIAVSYQTKVNLLSAIKSPCQRETPEGAEAKPWYEPIYLGGVCQLEKGDRLSAEINRPDYLDFAESGQVYFGIIAL

SEQ ID NO: 40 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 41 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAACLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 42 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDCAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 43 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVCLLSSQKMVYPGLQEPWLHSMYHGAAFQLTQGDQLSTHTDGIPHLVLSPSTVFFGAFAL

SEQ ID NO: 44 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPCLSSQKMVYPGLQEPWLHSMYHGAAFQLTQGDQLSTHTDGIPHLVLSPSTVFFGAFAL

SEQ ID NO: 45 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLCSSQKMVYPGLQEPWLHSMYHGAAFQLTQGDQLSTHTDGIPHLVLSPSTVFFGAFAL

SEQ ID NO: 46 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLCSQKMVYPGLQEPWLHSMYHGAAFQLTQGDQLSTHTDGIPHLVLSPSTVFFGAFAL

SEQ ID NO: 47 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSCQKMVYPGLQEPWLHSMYHGAAFQLTQGDQLSTHTDGIPHLVLSPSTVFFGAFAL

SEQ ID NO: 48 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSCKMVYPGLQEPWLHSMYHGAAFQLTQGDQLSTHTDGIPHLVLSPSTVFFGAFAL

SEQ ID NO: 49 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQCMVYPGLQEPWLHSMYHGAAFQLTQGDQLSTHTDGIPHLVLSPSTVFFGAFAL

SEQ ID NO: 50 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKCVYPGLQEPWLHSMYHGAAFQLTQGDQLSTHTDGIPHLVLSPSTVFFGAFAL

SEQ ID NO: 51 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPCLHSMYHGAAFQLTQGDQLSTHTDGIPHLVLSPSTVFFGAFAL

SEQ ID NO: 52 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWCHSMYHGAAFQLTQGDQLSTHTDGIPHLVLSPSTVFFGAFAL

SEQ ID NO: 53 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHCMYHGAAFQLTQGDQLSTHTDGIPHLVLSPSTVFFGAFAL

SEQ ID NO: 54 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGACFQLTQGDQLSTHTDGIPHLVLSPSTVFFGAFAL

SEQ ID NO: 55 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAACQLTQGDQLSTHTDGIPHLVLSPSTVFFGAFAL

SEQ ID NO: 56 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSCSTVFFGAFAL

SEQ ID NO: 57 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPCTVFFGAFAL

SEQ ID NO: 58 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSCVFFGAFAL

SEQ ID NO: 59 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVCLLSSQKMVYPGLQEPWLHSMYHGAAFQLTQGDQLSTHTDGIPHLVLSCSTVFFGAFAL

SEQ ID NO: 60 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVCLLSSQKMVYPGLQEPWLHSMYHGAAFQLTQGDQLSTHTDGIPHLVLSPCTVFFGAFAL

SEQ ID NO: 61 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPCLSSQKMVYPGLQEPWLHSMYHGAAFQLTQGDQLSTHTDGIPHLVLSCSTVFFGAFAL

SEQ ID NO: 62 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPCLSSQKMVYPGLQEPWLHSMYHGAAFQLTQGDQLSTHTDGIPHLVLSPCTVFFGAFAL

SEQ ID NO: 63 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLCSSQKMVYPGLQEPWLHSMYHGAAFQLTQGDQLSTHTDGIPHLVLSCSTVFFGAFAL

SEQ ID NO: 64 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLCSQKMVYPGLQEPWLHSMYHGAAFQLTQGDQLSTHTDGIPHLVLSPCTVFFGAFAL

SEQ ID NO: 65 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLCSQKMVYPGLQEPWLHSMYHGAAFQLTQGDQLSTHTDGIPHLVLSCSTVFFGAFAL

SEQ ID NO: 66 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLCSQKMVYPGLQEPWLHSMYHGAAFQLTQGDQLSTHTDGIPHLVLSPSCVFFGAFAL

SEQ ID NO: 67 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSCQKMVYPGLQEPWLHCMYHGAAFQLTQGDQLSTHTDGIPHLVLSPSTVFFGAFAL

SEQ ID NO: 68 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSCKMVYPGLQEPWCHSMYHGAAFQLTQGDQLSTHTDGIPHLVLSPSTVFFGAFAL

SEQ ID NO: 69 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSCKMVYPGLQEPWLHCMYHGAAFQLTQGDQLSTHTDGIPHLVLSPSTVFFGAFAL

SEQ ID NO: 70 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQCMVYPGLQEPWCHSMYHGAAFQLTQGDQLSTHTDGIPHLVLSPSTVFFGAFAL

SEQ ID NO: 71 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKCVYPGLQEPCLHSMYHGAAFQLTQGDQLSTHTDGIPHLVLSPSTVFFGAFAL

SEQ ID NO: 72 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKCVYPGLQEPWCHSMYHGAAFQLTQGDQLSTHTDGIPHLVLSPSTVFFGAFAL

SEQ ID NO: 73 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAACLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGACFQLTQGDQLSTHTDGIPHLVLSPSTVFFGAFAL

SEQ ID NO: 74 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAACLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAACQLTQGDQLSTHTDGIPHLVLSPSTVFFGAFAL

SEQ ID NO: 75 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDCAFLQDGFSLSNNSLLVPTSGIYFVYSQVVFSGKAYSPKATSSPLYLAHEVQLFSSQYPFHVPLLSSQKMVYPGLQEPWLHSMYHGAACQLTQGDQLSTHTDGIPHLVLSPSTVFFGAFAL

SEQ ID NO: 76 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 77 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAACLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 78 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKECAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 79 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPECLLEGAETVTPVLDPARRQGYGPLWYTSVGFGGLVQLRRGERVYVNISHPDMVDFARGKTFFGAVMVG

SEQ ID NO: 80 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELCLEGAETVTPVLDPARRQGYGPLWYTSVGFGGLVQLRRGERVYVNISHPDMVDFARGKTFFGAVMVG

SEQ ID NO: 81 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLCEGAETVTPVLDPARRQGYGPLWYTSVGFGGLVQLRRGERVYVNISHPDMVDFARGKTFFGAVMVG

SEQ ID NO: 82 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLCGAETVTPVLDPARRQGYGPLWYTSVGFGGLVQLRRGERVYVNISHPDMVDFARGKTFFGAVMVG

SEQ ID NO: 83 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLECAETVTPVLDPARRQGYGPLWYTSVGFGGLVQLRRGERVYVNISHPDMVDFARGKTFFGAVMVG

SEQ ID NO: 84 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGCETVTPVLDPARRQGYGPLWYTSVGFGGLVQLRRGERVYVNISHPDMVDFARGKTFFGAVMVG

SEQ ID NO: 85 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGACTVTPVLDPARRQGYGPLWYTSVGFGGLVQLRRGERVYVNISHPDMVDFARGKTFFGAVMVG

SEQ ID NO: 86 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAECVTPVLDPARRQGYGPLWYTSVGFGGLVQLRRGERVYVNISHPDMVDFARGKTFFGAVMVG

SEQ ID NO: 87 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLCYTSVGFGGLVQLRRGERVYVNISHPDMVDFARGKTFFGAVMVG

SEQ ID NO: 88 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWCTSVGFGGLVQLRRGERVYVNISHPDMVDFARGKTFFGAVMVG

SEQ ID NO: 89 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTCVGFGGLVQLRRGERVYVNISHPDMVDFARGKTFFGAVMVG

SEQ ID NO: 90 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGCVQLRRGERVYVNISHPDMVDFARGKTFFGAVMVG

SEQ ID NO: 91 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLCQLRRGERVYVNISHPDMVDFARGKTFFGAVMVG

SEQ ID NO: 92 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFACGKTFFGAVMVG

SEQ ID NO: 93 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARCKTFFGAVMVG

SEQ ID NO: 94 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGCTFFGAVMVG

SEQ ID NO: 95 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPECLLEGAETVTPVLDPARRQGYGPLWYTSVGFGGLVQLRRGERVYVNISHPDMVDFACGKTFFGAVMVG

SEQ ID NO: 96 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPECLLEGAETVTPVLDPARRQGYGPLWYTSVGFGGLVQLRRGERVYVNISHPDMVDFARCKTFFGAVMVG

SEQ ID NO: 97 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELCLEGAETVTPVLDPARRQGYGPLWYTSVGFGGLVQLRRGERVYVNISHPDMVDFACGKTFFGAVMVG

SEQ ID NO: 98 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELCLEGAETVTPVLDPARRQGYGPLWYTSVGFGGLVQLRRGERVYVNISHPDMVDFARCKTFFGAVMVG

SEQ ID NO: 99 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLCEGAETVTPVLDPARRQGYGPLWYTSVGFGGLVQLRRGERVYVNISHPDMVDFACGKTFFGAVMVG

SEQ ID NO: 100 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLCGAETVTPVLDPARRQGYGPLWYTSVGFGGLVQLRRGERVYVNISHPDMVDFACGKTFFGAVMVG

SEQ ID NO: 101 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLCGAETVTPVLDPARRQGYGPLWYTSVGFGGLVQLRRGERVYVNISHPDMVDFARCKTFFGAVMVG

SEQ ID NO: 102 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLCGAETVTPVLDPARRQGYGPLWYTSVGFGGLVQLRRGERVYVNISHPDMVDFARGCTFFGAVMVG

SEQ ID NO: 103 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLECAETVTPVLDPARRQGYGPLWYTCVGFGGLVQLRRGERVYVNISHPDMVDFARGKTFFGAVMVG

SEQ ID NO: 104 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGCETVTPVLDPARRQGYGPLWCTSVGFGGLVQLRRGERVYVNISHPDMVDFARGKTFFGAVMVG

SEQ ID NO: 105 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGCETVTPVLDPARRQGYGPLWYTCVGFGGLVQLRRGERVYVNISHPDMVDFARGKTFFGAVMVG

SEQ ID NO: 106 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGACTVTPVLDPARRQGYGPLWCTSVGFGGLVQLRRGERVYVNISHPDMVDFARGKTFFGAVMVG

SEQ ID NO: 107 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAECVTPVLDPARRQGYGPLCYTSVGFGGLVQLRRGERVYVNISHPDMVDFARGKTFFGAVMVG

SEQ ID NO: 108 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAECVTPVLDPARRQGYGPLWCTSVGFGGLVQLRRGERVYVNISHPDMVDFARGKTFFGAVMVG

SEQ ID NO: 109 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAACLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGCVQLRRGERVYVNISHPDMVDFARGKTFFGAVMVG

SEQ ID NO: 110 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAACLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLCQLRRGERVYVNISHPDMVDFARGKTFFGAVMVG

SEQ ID NO: 111 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKECAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLCQLRRGERVYVNISHPDMVDFARGKTFFGAVMVG

SEQ ID NO: 112 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 113 - protein, 183 aa, Artificial Sequence
  Synthetic Construct
MERVQPLEENVGNAARPRFERNKLLLVASVIQGLGLLLCFTYICLHFSALQVSHRYPRIQSICVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 114 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEECLFQLKKVRSVNSLMVASLTYKDKVYLNVTTDNTSLDDFHVNGGELILIHQNPGEFCVL

SEQ ID NO: 115 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPCFQLKKVRSVNSLMVASLTYKDKVYLNVTTDNTSLDDFHVNGGELILIHQNPGEFCVL

SEQ ID NO: 116 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFCLKKVRSVNSLMVASLTYKDKVYLNVTTDNTSLDDFHVNGGELILIHQNPGEFCVL

SEQ ID NO: 117 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQCKKVRSVNSLMVASLTYKDKVYLNVTTDNTSLDDFHVNGGELILIHQNPGEFCVL

SEQ ID NO: 118 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLCKVRSVNSLMVASLTYKDKVYLNVTTDNTSLDDFHVNGGELILIHQNPGEFCVL

SEQ ID NO: 119 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRCVNSLMVASLTYKDKVYLNVTTDNTSLDDFHVNGGELILIHQNPGEFCVL

SEQ ID NO: 120 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMCASLTYKDKVYLNVTTDNTSLDDFHVNGGELILIHQNPGEFCVL

SEQ ID NO: 121 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVCSLTYKDKVYLNVTTDNTSLDDFHVNGGELILIHQNPGEFCVL

SEQ ID NO: 122 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVCGGELILIHQNPGEFCVL

SEQ ID NO: 123 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNCGELILIHQNPGEFCVL

SEQ ID NO: 124 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEECLFQLKKVRSVNSLMVASLTYKDKVYLNVTTDNTSLDDFHVCGGELILIHQNPGEFCVL

SEQ ID NO: 125 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPCFQLKKVRSVNSLMVASLTYKDKVYLNVTTDNTSLDDFHVCGGELILIHQNPGEFCVL

SEQ ID NO: 126 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFCLKKVRSVNSLMVASLTYKDKVYLNVTTDNTSLDDFHVCGGELILIHQNPGEFCVL

SEQ ID NO: 127 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFCLKKVRSVNSLMVASLTYKDKVYLNVTTDNTSLDDFHVNCGELILIHQNPGEFCVL

SEQ ID NO: 128 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQCKKVRCVNSLMVASLTYKDKVYLNVTTDNTSLDDFHVNGGELILIHQNPGEFCVL

SEQ ID NO: 129 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLCKVRCVNSLMVASLTYKDKVYLNVTTDNTSLDDFHVNGGELILIHQNPGEFCVL

SEQ ID NO: 130 - protein, 183 aa, Artificial Sequence
  Synthetic Construct
MERVQPLEENVGNAARPRFERNKLLLVASVIQGLGLLLCFTYICLHFSALQVSHRYPRIQSICVQFTEYKKEKGFILTSQKEDEIMKVQNNSVIINCDGFYLISLKGYFSQEVNISLHYQKDEEPLFQLKKVRSVNSLMCASLTYKDKVYLNVTTDNTSLDDFHVNGGELILIHQNPGEFCVL

SEQ ID NO: 131 - protein, 183 aa, Artificial Sequence
  Synthetic Construct
MERVQPLEENVGNAARPRFERNKLLLVASVIQGLGLLLCFTYICLHFSALQVSHRYPRIQSICVQFTEYKKEKGFILTSQKEDEIMKVQNNSVIINCDGFYLISLKGYFSQEVNISLHYQKDEEPLFQLKKVRSVNSLMVCSLTYKDKVYLNVTTDNTSLDDFHVNGGELILIHQNPGEFCVL

SEQ ID NO: 132 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 133 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAACVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 134 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGCYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 135 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERCLLRAANTHSSAKPCGQQSIHLGGVFELQPGASVFVNVTDPSQVSHGTGFTSFGLLKL

SEQ ID NO: 136 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERICLRAANTHSSAKPCGQQSIHLGGVFELQPGASVFVNVTDPSQVSHGTGFTSFGLLKL

SEQ ID NO: 137 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILCRAANTHSSAKPCGQQSIHLGGVFELQPGASVFVNVTDPSQVSHGTGFTSFGLLKL

SEQ ID NO: 138 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLCAANTHSSAKPCGQQSIHLGGVFELQPGASVFVNVTDPSQVSHGTGFTSFGLLKL

SEQ ID NO: 139 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRCANTHSSAKPCGQQSIHLGGVFELQPGASVFVNVTDPSQVSHGTGFTSFGLLKL

SEQ ID NO: 140 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRACNTHSSAKPCGQQSIHLGGVFELQPGASVFVNVTDPSQVSHGTGFTSFGLLKL

SEQ ID NO: 141 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANCHSSAKPCGQQSIHLGGVFELQPGASVFVNVTDPSQVSHGTGFTSFGLLKL

SEQ ID NO: 142 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCCQQSIHLGGVFELQPGASVFVNVTDPSQVSHGTGFTSFGLLKL

SEQ ID NO: 143 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGCQSIHLGGVFELQPGASVFVNVTDPSQVSHGTGFTSFGLLKL

SEQ ID NO: 144 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQCIHLGGVFELQPGASVFVNVTDPSQVSHGTGFTSFGLLKL

SEQ ID NO: 145 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGCFELQPGASVFVNVTDPSQVSHGTGFTSFGLLKL

SEQ ID NO: 146 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVCELQPGASVFVNVTDPSQVSHGTGFTSFGLLKL

SEQ ID NO: 147 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGCGFTSFGLLKL

SEQ ID NO: 148 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTCFTSFGLLKL

SEQ ID NO: 149 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGCTSFGLLKL

SEQ ID NO: 150 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERCLLRAANTHSSAKPCGQQSIHLGGVFELQPGASVFVNVTDPSQVSHGCGFTSFGLLKL

SEQ ID NO: 151 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERCLLRAANTHSSAKPCGQQSIHLGGVFELQPGASVFVNVTDPSQVSHGTCFTSFGLLKL

SEQ ID NO: 152 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERICLRAANTHSSAKPCGQQSIHLGGVFELQPGASVFVNVTDPSQVSHGCGFTSFGLLKL

SEQ ID NO: 153 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERICLRAANTHSSAKPCGQQSIHLGGVFELQPGASVFVNVTDPSQVSHGTCFTSFGLLKL

SEQ ID NO: 154 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILCRAANTHSSAKPCGQQSIHLGGVFELQPGASVFVNVTDPSQVSHGCGFTSFGLLKL

SEQ ID NO: 155 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLCAANTHSSAKPCGQQSIHLGGVFELQPGASVFVNVTDPSQVSHGCGFTSFGLLKL

SEQ ID NO: 156 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLCAANTHSSAKPCGQQSIHLGGVFELQPGASVFVNVTDPSQVSHGTCFTSFGLLKL

SEQ ID NO: 157 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLCAANTHSSAKPCGQQSIHLGGVFELQPGASVFVNVTDPSQVSHGTGCTSFGLLKL

SEQ ID NO: 158 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRCANTHSSAKPCGQQCIHLGGVFELQPGASVFVNVTDPSQVSHGTGFTSFGLLKL

SEQ ID NO: 159 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRACNTHSSAKPCGCQSIHLGGVFELQPGASVFVNVTDPSQVSHGTGFTSFGLLKL

SEQ ID NO: 160 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRACNTHSSAKPCGQQCIHLGGVFELQPGASVFVNVTDPSQVSHGTGFTSFGLLKL

SEQ ID NO: 161 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAACTHSSAKPCGCQSIHLGGVFELQPGASVFVNVTDPSQVSHGTGFTSFGLLKL

SEQ ID NO: 162 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANCHSSAKPCCQQSIHLGGVFELQPGASVFVNVTDPSQVSHGTGFTSFGLLKL

SEQ ID NO: 163 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANCHSSAKPCGCQSIHLGGVFELQPGASVFVNVTDPSQVSHGTGFTSFGLLKL

SEQ ID NO: 164 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAACVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGCFELQPGASVFVNVTDPSQVSHGTGFTSFGLLKL

SEQ ID NO: 165 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAACVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVCELQPGASVFVNVTDPSQVSHGTGFTSFGLLKL

SEQ ID NO: 166 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGCYTMSNNLVTLENGKQLTVKRQGLYYIYAQVTFCSNREASSQAPFIASLCLKSPGRFERILLRAANTHSSAKPCGQQSIHLGGVCELQPGASVFVNVTDPSQVSHGTGFTSFGLLKL

SEQ ID NO: 167 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 168 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVACLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 169 - protein, 281 aa, Artificial Sequence
  Synthetic construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGCVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 170 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLCMMEGKMMSYCTTGQMWARSSYLGAVFNLTSADHLYVNVSELSLVNFEESQTFFGLYKL

SEQ ID NO: 171 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVCMEGKMMSYCTTGQMWARSSYLGAVFNLTSADHLYVNVSELSLVNFEESQTFFGLYKL

SEQ ID NO: 172 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMCEGKMMSYCTTGQMWARSSYLGAVFNLTSADHLYVNVSELSLVNFEESQTFFGLYKL

SEQ ID NO: 173 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMCGKMMSYCTTGQMWARSSYLGAVFNLTSADHLYVNVSELSLVNFEESQTFFGLYKL

SEQ ID NO: 174 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMECKMMSYCTTGQMWARSSYLGAVFNLTSADHLYVNVSELSLVNFEESQTFFGLYKL

SEQ ID NO: 175 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGCMMSYCTTGQMWARSSYLGAVFNLTSADHLYVNVSELSLVNFEESQTFFGLYKL

SEQ ID NO: 176 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKCMSYCTTGQMWARSSYLGAVFNLTSADHLYVNVSELSLVNFEESQTFFGLYKL

SEQ ID NO: 177 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMCSYCTTGQMWARSSYLGAVFNLTSADHLYVNVSELSLVNFEESQTFFGLYKL

SEQ ID NO: 178 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMCARSSYLGAVFNLTSADHLYVNVSELSLVNFEESQTFFGLYKL

SEQ ID NO: 179 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWCRSSYLGAVFNLTSADHLYVNVSELSLVNFEESQTFFGLYKL

SEQ ID NO: 180 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARCSYLGAVFNLTSADHLYVNVSELSLVNFEESQTFFGLYKL

SEQ ID NO: 181 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGACFNLTSADHLYVNVSELSLVNFEESQTFFGLYKL

SEQ ID NO: 182 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVCNLTSADHLYVNVSELSLVNFEESQTFFGLYKL

SEQ ID NO: 183 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFECSQTFFGLYKL

SEQ ID NO: 184 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEECQTFFGLYKL

SEQ ID NO: 185 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESCTFFGLYKL

SEQ ID NO: 186 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLCMMEGKMMSYCTTGQMWARSSYLGAVFNLTSADHLYVNVSELSLVNFECSQTFFGLYKL

SEQ ID NO: 187 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLCMMEGKMMSYCTTGQMWARSSYLGAVFNLTSADHLYVNVSELSLVNFEECQTFFGLYKL

SEQ ID NO: 188 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVCMEGKMMSYCTTGQMWARSSYLGAVFNLTSADHLYVNVSELSLVNFECSQTFFGLYKL

SEQ ID NO: 189 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVCMEGKMMSYCTTGQMWARSSYLGAVFNLTSADHLYVNVSELSLVNFEECQTFFGLYKL

SEQ ID NO: 190 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMCEGKMMSYCTTGQMWARSSYLGAVFNLTSADHLYVNVSELSLVNFECSQTFFGLYKL

SEQ ID NO: 191 - protein, 281 aa, Artificial Sequence
  Synthetic Sequences
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMCGKMMSYCTTGQMWARSSYLGAVFNLTSADHLYVNVSELSLVNFECSQTFFGLYKL

SEQ ID NO: 192 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMCGKMMSYCTTGQMWARSSYLGAVFNLTSADHLYVNVSELSLVNFEECQTFFGLYKL

SEQ ID NO: 193 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMCGKMMSYCTTGQMWARSSYLGAVFNLTSADHLYVNVSELSLVNFEESCTFFGLYKL

SEQ ID NO: 194 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMECKMMSYCTTGQMWARCSYLGAVFNLTSADHLYVNVSELSLVNFEESQTFFGLYKL

SEQ ID NO: 195 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGCMMSYCTTGQMWCRSSYLGAVFNLTSADHLYVNVSELSLVNFEESQTFFGLYKL

SEQ ID NO: 196 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGCMMSYCTTGQMWARCSYLGAVFNLTSADHLYVNVSELSLVNFEESQTFFGLYKL

SEQ ID NO: 197 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKCMSYCTTGQMWCRSSYLGAVFNLTSADHLYVNVSELSLVNFEESQTFFGLYKL

SEQ ID NO: 198 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMCSYCTTGQMCARSSYLGAVFNLTSADHLYVNVSELSLVNFEESQTFFGLYKL

SEQ ID NO: 199 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMCSYCTTGQMWCRSSYLGAVFNLTSADHLYVNVSELSLVNFEESQTFFGLYKL

SEQ ID NO: 200 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVACLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGACFNLTSADHLYVNVSELSLVNFEESQTFFGLYKL

SEQ ID NO: 201 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVACLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVCNLTSADHLYVNVSELSLVNFEESQTFFGLYKL

SEQ ID NO: 202 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGCVLLSGVKYKKGGLVINETGLYFVYSKVYFRGQSCNNLPLSHKVYMRNSKYPQDLVMMEGKMMSYCTTGQMWARSSYLGAVCNLTSADHLYVNVSELSLVNFEESQTFFGLYKL

SEQ ID NO: 203 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 204 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGCSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 205 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTCLAVGICSPASRSISLLRLSFHQGCTIASQRLTPLARGDTLCTNLTGTLLPSRNTDETFFGVQWVRP

SEQ ID NO: 206 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTCAVGICSPASRSISLLRLSFHQGCTIASQRLTPLARGDTLCTNLTGTLLPSRNTDETFFGVQWVRP

SEQ ID NO: 207 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLCVGICSPASRSISLLRLSFHQGCTIASQRLTPLARGDTLCTNLTGTLLPSRNTDETFFGVQWVRP

SEQ ID NO: 208 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLACGICSPASRSISLLRLSFHQGCTIASQRLTPLARGDTLCTNLTGTLLPSRNTDETFFGVQWVRP

SEQ ID NO: 209 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVCICSPASRSISLLRLSFHQGCTIASQRLTPLARGDTLCTNLTGTLLPSRNTDETFFGVQWVRP

SEQ ID NO: 210 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGCCSPASRSISLLRLSFHQGCTIASQRLTPLARGDTLCTNLTGTLLPSRNTDETFFGVQWVRP

SEQ ID NO: 211 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICCPASRSISLLRLSFHQGCTIASQRLTPLARGDTLCTNLTGTLLPSRNTDETFFGVQWVRP

SEQ ID NO: 212 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPACRSISLLRLSFHQGCTIASQRLTPLARGDTLCTNLTGTLLPSRNTDETFFGVQWVRP

SEQ ID NO: 213 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRCISLLRLSFHQGCTIASQRLTPLARGDTLCTNLTGTLLPSRNTDETFFGVQWVRP

SEQ ID NO: 214 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHCGCTIASQRLTPLARGDTLCTNLTGTLLPSRNTDETFFGVQWVRP

SEQ ID NO: 215 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQCCTIASQRLTPLARGDTLCTNLTGTLLPSRNTDETFFGVQWVRP

SEQ ID NO: 216 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCCIASQRLTPLARGDTLCTNLTGTLLPSRNTDETFFGVQWVRP

SEQ ID NO: 217 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLCPLARGDTLCTNLTGTLLPSRNTDETFFGVQWVRP

SEQ ID NO: 218 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNCDETFFGVQWVRP

SEQ ID NO: 219 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTCETFFGVQWVRP

SEQ ID NO: 220 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDCTFFGVQWVRP

SEQ ID NO: 221 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTCLAVGICSPASRSISLLRLSFHQGCTIASQRLTPLARGDTLCTNLTGTLLPSRNCDETFFGVQWVRP

SEQ ID NO: 222 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTCLAVGICSPASRSISLLRLSFHQGCTIASQRLTPLARGDTLCTNLTGTLLPSRNTCETFFGVQWVRP

SEQ ID NO: 223 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTCAVGICSPASRSISLLRLSFHQGCTIASQRLTPLARGDTLCTNLTGTLLPSRNCDETFFGVQWVRP

SEQ ID NO: 224 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTCAVGICSPASRSISLLRLSFHQGCTIASQRLTPLARGDTLCTNLTGTLLPSRNTCETFFGVQWVRP

SEQ ID NO: 225 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLCVGICSPASRSISLLRLSFHQGCTIASQRLTPLARGDTLCTNLTGTLLPSRNCDETFFGVQWVRP

SEQ ID NO: 226 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLACGICSPASRSISLLRLSFHQGCTIASQRLTPLARGDTLCTNLTGTLLPSRNCDETFFGVQWVRP

SEQ ID NO: 227 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLACGICSPASRSISLLRLSFHQGCTIASQRLTPLARGDTLCTNLTGTLLPSRNTCETFFGVQWVRP

SEQ ID NO: 228 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLACGICSPASRSISLLRLSFHQGCTIASQRLTPLARGDTLCTNLTGTLLPSRNTDCTFFGVQWVRP

SEQ ID NO: 229 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVCICSPASRSISLLRLSFHQGCCIASQRLTPLARGDTLCTNLTGTLLPSRNTDETFFGVQWVRP

SEQ ID NO: 230 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGCCSPASRSISLLRLSFHQCCTIASQRLTPLARGDTLCTNLTGTLLPSRNTDETFFGVQWVRP

SEQ ID NO: 231 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGCCSPASRSISLLRLSFHQGCCIASQRLTPLARGDTLCTNLTGTLLPSRNTDETFFGVQWVRP

SEQ ID NO: 232 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICCPASRSISLLRLSFHCGCTIASQRLTPLARGDTLCTNLTGTLLPSRNTDETFFGVQWVRP

SEQ ID NO: 233 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICCPASRSISLLRLSFHQCCTIASQRLTPLARGDTLCTNLTGTLLPSRNTDETFFGVQWVRP

SEQ ID NO: 234 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPACRCISLLRLSFHQGCTIASQRLTPLARGDTLCTNLTGTLLPSRNTDETFFGVQWVRP

SEQ ID NO: 235 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGCSFLHGPELDKGQLRIHRDGIYMVHIQVTLAICSSTTASRHHPTTLAVGICSPASRSISLLRLSFHQGCTIASQRLCPLARGDTLCTNLTGTLLPSRNTDETFFGVQWVRP

SEQ ID NO: 236 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 237 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWACLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 238 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQCLVTVCESGMQTKHVYQNLSQFLLDYLQVNTTISVNVDTFQYIDTSTFPLENVLSIFLYSNSD

SEQ ID NO: 239 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQACVTVCESGMQTKHVYQNLSQFLLDYLQVNTTISVNVDTFQYIDTSTFPLENVLSIFLYSNSD

SEQ ID NO: 240 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALCTVCESGMQTKHVYQNLSQFLLDYLQVNTTISVNVDTFQYIDTSTFPLENVLSIFLYSNSD

SEQ ID NO: 241 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVCVCESGMQTKHVYQNLSQFLLDYLQVNTTISVNVDTFQYIDTSTFPLENVLSIFLYSNSD

SEQ ID NO: 242 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTCCESGMQTKHVYQNLSQFLLDYLQVNTTISVNVDTFQYIDTSTFPLENVLSIFLYSNSD

SEQ ID NO: 243 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCCSGMQTKHVYQNLSQFLLDYLQVNTTISVNVDTFQYIDTSTFPLENVLSIFLYSNSD

SEQ ID NO: 244 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCECGMQTKHVYQNLSQFLLDYLQVNTTISVNVDTFQYIDTSTFPLENVLSIFLYSNSD

SEQ ID NO: 245 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHCYQNLSQFLLDYLQVNTTISVNVDTFQYIDTSTFPLENVLSIFLYSNSD

SEQ ID NO: 246 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVCQNLSQFLLDYLQVNTTISVNVDTFQYIDTSTFPLENVLSIFLYSNSD

SEQ ID NO: 247 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQCLSQFLLDYLQVNTTISVNVDTFQYIDTSTFPLENVLSIFLYSNSD

SEQ ID NO: 248 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLCDYLQVNTTISVNVDTFQYIDTSTFPLENVLSIFLYSNSD

SEQ ID NO: 249 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLCYLQVNTTISVNVDTFQYIDTSTFPLENVLSIFLYSNSD

SEQ ID NO: 250 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFCLENVLSIFLYSNSD

SEQ ID NO: 251 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPCENVLSIFLYSNSD

SEQ ID NO: 252 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLCNVLSIFLYSNSD

SEQ ID NO: 253 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQCLVTVCESGMQTKHVYQNLSQFLLDYLQVNTTISVNVDTFQYIDTSTFCLENVLSIFLYSNSD

SEQ ID NO: 254 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQCLVTVCESGMQTKHVYQNLSQFLLDYLQVNTTISVNVDTFQYIDTSTFPCENVLSIFLYSNSD

SEQ ID NO: 255 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQACVTVCESGMQTKHVYQNLSQFLLDYLQVNTTISVNVDTFQYIDTSTFCLENVLSIFLYSNSD

SEQ ID NO: 256 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQACVTVCESGMQTKHVYQNLSQFLLDYLQVNTTISVNVDTFQYIDTSTFPCENVLSIFLYSNSD

SEQ ID NO: 257 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALCTVCESGMQTKHVYQNLSQFLLDYLQVNTTISVNVDTFQYIDTSTFCLENVLSIFLYSNSD

SEQ ID NO: 258 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVCVCESGMQTKHVYQNLSQFLLDYLQVNTTISVNVDTFQYIDTSTFCLENVLSIFLYSNSD

SEQ ID NO: 259 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVCVCESGMQTKHVYQNLSQFLLDYLQVNTTISVNVDTFQYIDTSTFPCENVLSIFLYSNSD

SEQ ID NO: 260 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVCVCESGMQTKHVYQNLSQFLLDYLQVNTTISVNVDTFQYIDTSTFPLCNVLSIFLYSNSD

SEQ ID NO: 261 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTCCESGMQTKHVYQCLSQFLLDYLQVNTTISVNVDTFQYIDTSTFPLENVLSIFLYSNSD

SEQ ID NO: 262 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCCSGMQTKHVCQNLSQFLLDYLQVNTTISVNVDTFQYIDTSTFPLENVLSIFLYSNSD

SEQ ID NO: 263 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCECGMQTKHCYQNLSQFLLDYLQVNTTISVNVDTFQYIDTSTFPLENVLSIFLYSNSD

SEQ ID NO: 264 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCECGMQTKHVCQNLSQFLLDYLQVNTTISVNVDTFQYIDTSTFPLENVLSIFLYSNSD

SEQ ID NO: 265 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWACLQVAKHLNKTKLSWNKDGILHGVRYQDGNLVIQFPGLYFIICQLQFLVQCPNNSVDLKLELLINKHIKKQALVTVCESGMQTKHVYQNLSQFLCDYLQVNTTISVNVDTFQYIDTSTFPLENVLSIFLYSNSD

SEQ ID NO: 266 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWACLQVAKHLNKTKLSWNKDGILHGVRYQDGNLVIQFPGLYFIICQLQFLVQCPNNSVDLKLELLINKHIKKQALVTVCESGMQTKHVYQNLSQFLLCYLQVNTTISVNVDTFQYIDTSTFPLENVLSIFLYSNSD

SEQ ID NO: 267 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 268 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFACLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 269 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGCAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 270 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAACLALTVDLPPASSEARNSAFGFQGRLLHLSAGQRLGVHLHTEARARHAWQLTQGATVLGLFRVTPEIPAGLPSPRSE

SEQ ID NO: 271 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAACALTVDLPPASSEARNSAFGFQGRLLHLSAGQRLGVHLHTEARARHAWQLTQGATVLGLFRVTPEIPAGLPSPRSE

SEQ ID NO: 272 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALACTVDLPPASSEARNSAFGFQGRLLHLSAGQRLGVHLHTEARARHAWQLTQGATVLGLFRVTPEIPAGLPSPRSE

SEQ ID NO: 273 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALCVDLPPASSEARNSAFGFQGRLLHLSAGQRLGVHLHTEARARHAWQLTQGATVLGLFRVTPEIPAGLPSPRSE

SEQ ID NO: 274 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTCDLPPASSEARNSAFGFQGRLLHLSAGQRLGVHLHTEARARHAWQLTQGATVLGLFRVTPEIPAGLPSPRSE

SEQ ID NO: 275 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVCLPPASSEARNSAFGFQGRLLHLSAGQRLGVHLHTEARARHAWQLTQGATVLGLFRVTPEIPAGLPSPRSE

SEQ ID NO: 276 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDCPPASSEARNSAFGFQGRLLHLSAGQRLGVHLHTEARARHAWQLTQGATVLGLFRVTPEIPAGLPSPRSE

SEQ ID NO: 277 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARCSAFGFQGRLLHLSAGQRLGVHLHTEARARHAWQLTQGATVLGLFRVTPEIPAGLPSPRSE

SEQ ID NO: 278 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNCAFGFQGRLLHLSAGQRLGVHLHTEARARHAWQLTQGATVLGLFRVTPEIPAGLPSPRSE

SEQ ID NO: 279 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSACGFQGRLLHLSAGQRLGVHLHTEARARHAWQLTQGATVLGLFRVTPEIPAGLPSPRSE

SEQ ID NO: 280 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRCLHLSAGQRLGVHLHTEARARHAWQLTQGATVLGLFRVTPEIPAGLPSPRSE

SEQ ID NO: 281 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLCHLSAGQRLGVHLHTEARARHAWQLTQGATVLGLFRVTPEIPAGLPSPRSE

SEQ ID NO: 282 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQCATVLGLFRVTPEIPAGLPSPRSE

SEQ ID NO: 283 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGCTVLGLFRVTPEIPAGLPSPRSE

SEQ ID NO: 284 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAACLALTVDLPPASSEARNSAFGFQGRLLHLSAGQRLGVHLHTEARARHAWQLTQCATVLGLFRVTPEIPAGLPSPRSE

SEQ ID NO: 285 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAACALTVDLPPASSEARNSAFGFQGRLLHLSAGQRLGVHLHTEARARHAWQLTQCATVLGLFRVTPEIPAGLPSPRSE

SEQ ID NO: 286 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALACTVDLPPASSEARNSAFGFQGRLLHLSAGQRLGVHLHTEARARHAWQLTQCATVLGLFRVTPEIPAGLPSPRSE

SEQ ID NO: 287 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALACTVDLPPASSEARNSAFGFQGRLLHLSAGQRLGVHLHTEARARHAWQLTQGCTVLGLFRVTPEIPAGLPSPRSE

SEQ ID NO: 288 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALCVDLPPASSEARNSACGFQGRLLHLSAGQRLGVHLHTEARARHAWQLTQGATVLGLFRVTPEIPAGLPSPRSE

SEQ ID NO: 289 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTCDLPPASSEARNCAFGFQGRLLHLSAGQRLGVHLHTEARARHAWQLTQGATVLGLFRVTPEIPAGLPSPRSE

SEQ ID NO: 290 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTCDLPPASSEARNSACGFQGRLLHLSAGQRLGVHLHTEARARHAWQLTQGATVLGLFRVTPEIPAGLPSPRSE

SEQ ID NO: 291 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVCLPPASSEARNCAFGFQGRLLHLSAGQRLGVHLHTEARARHAWQLTQGATVLGLFRVTPEIPAGLPSPRSE

SEQ ID NO: 292 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDCPPASSEARCSAFGFQGRLLHLSAGQRLGVHLHTEARARHAWQLTQGATVLGLFRVTPEIPAGLPSPRSE

SEQ ID NO: 293 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDCPPASSEARNCAFGFQGRLLHLSAGQRLGVHLHTEARARHAWQLTQGATVLGLFRVTPEIPAGLPSPRSE

SEQ ID NO: 294 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFACLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRCLHLSAGQRLGVHLHTEARARHAWQLTQGATVLGLFRVTPEIPAGLPSPRSE

SEQ ID NO: 295 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFACLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLCHLSAGQRLGVHLHTEARARHAWQLTQGATVLGLFRVTPEIPAGLPSPRSE

SEQ ID NO: 296 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGCAGVSLTGGLSYKEDTKELVVAKAGVYYVFFQLELRRVVAGEGSGSVSLALHLQPLRSAAGAAALALTVDLPPASSEARNSAFGFQGRLCHLSAGQRLGVHLHTEARARHAWQLTQGATVLGLFRVTPEIPAGLPSPRSE

SEQ ID NO: 297 - protein, 281 aa, Homo sapiens [sequence omitted]

SEQ ID NO: 298 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAACITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 299 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKACGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 300 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPICLMKSARNSCWSKDAEYGLYSIYQGGIFELKENDRIFVSVTNEHLIDMDHEASFFGAFLVG

SEQ ID NO: 301 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILCMKSARNSCWSKDAEYGLYSIYQGGIFELKENDRIFVSVTNEHLIDMDHEASFFGAFLVG

SEQ ID NO: 302 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLCKSARNSCWSKDAEYGLYSIYQGGIFELKENDRIFVSVTNEHLIDMDHEASFFGAFLVG

SEQ ID NO: 303 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMCSARNSCWSKDAEYGLYSIYQGGIFELKENDRIFVSVTNEHLIDMDHEASFFGAFLVG

SEQ ID NO: 304 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKCARNSCWSKDAEYGLYSIYQGGIFELKENDRIFVSVTNEHLIDMDHEASFFGAFLVG

SEQ ID NO: 305 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSACNSCWSKDAEYGLYSIYQGGIFELKENDRIFVSVTNEHLIDMDHEASFFGAFLVG

SEQ ID NO: 306 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARCSCWSKDAEYGLYSIYQGGIFELKENDRIFVSVTNEHLIDMDHEASFFGAFLVG

SEQ ID NO: 307 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSSWSKDAEYGLYSIYQGGIFELKENDRIFVSVTNEHLIDMDHEASFFGAFLVG

SEQ ID NO: 308 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYCLYSIYQGGIFELKENDRIFVSVTNEHLIDMDHEASFFGAFLVG

SEQ ID NO: 309 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGCYSIYQGGIFELKENDRIFVSVTNEHLIDMDHEASFFGAFLVG

SEQ ID NO: 310 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYCIYQGGIFELKENDRIFVSVTNEHLIDMDHEASFFGAFLVG

SEQ ID NO: 311 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGCFELKENDRIFVSVTNEHLIDMDHEASFFGAFLVG

SEQ ID NO: 312 - protein, 281 aa, Artificial Sequence; identical to SEQ ID NO: 311
  Synthetic Construct

SEQ ID NO: 313 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDCEASFFGAFLVG

SEQ ID NO: 314 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHCASFFGAFLVG

SEQ ID NO: 315 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHECSFFGAFLVG

SEQ ID NO: 316 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPICLMKSARNSCWSKDAEYGLYSIYQGGIFELKENDRIFVSVTNEHLIDMDCEASFFGAFLVG

SEQ ID NO: 317 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPICLMKSARNSCWSKDAEYGLYSIYQGGIFELKENDRIFVSVTNEHLIDMDHCASFFGAFLVG

SEQ ID NO: 318 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILCMKSARNSCWSKDAEYGLYSIYQGGIFELKENDRIFVSVTNEHLIDMDCEASFFGAFLVG

SEQ ID NO: 319 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILCMKSARNSCWSKDAEYGLYSIYQGGIFELKENDRIFVSVTNEHLIDMDHCASFFGAFLVG

SEQ ID NO: 320 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLCKSARNSCWSKDAEYGLYSIYQGGIFELKENDRIFVSVTNEHLIDMDCEASFFGAFLVG

SEQ ID NO: 321 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMCSARNSCWSKDAEYGLYSIYQGGIFELKENDRIFVSVTNEHLIDMDCEASFFGAFLVG

SEQ ID NO: 322 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMCSARNSCWSKDAEYGLYSIYQGGIFELKENDRIFVSVTNEHLIDMDHCASFFGAFLVG

SEQ ID NO: 323 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMCSARNSCWSKDAEYGLYSIYQGGIFELKENDRIFVSVTNEHLIDMDHECSFFGAFLVG

SEQ ID NO: 324 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKCARNSCWSKDAEYGLYCIYQGGIFELKENDRIFVSVTNEHLIDMDHEASFFGAFLVG

SEQ ID NO: 325 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSCRNSCWSKDAEYGCYSIYQGGIFELKENDRIFVSVTNEHLIDMDHEASFFGAFLVG

SEQ ID NO: 326 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSCRNSCWSKDAEYGLYCIYQGGIFELKENDRIFVSVTNEHLIDMDHEASFFGAFLVG

SEQ ID NO: 327 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSACNSCWSKDAEYGCYSIYQGGIFELKENDRIFVSVTNEHLIDMDHEASFFGAFLVG

SEQ ID NO: 328 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARCSCWSKDAEYCLYSIYQGGIFELKENDRIFVSVTNEHLIDMDHEASFFGAFLVG

SEQ ID NO: 329 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARCSCWSKDAEYGCYSIYQGGIFELKENDRIFVSVTNEHLIDMDHEASFFGAFLVG

SEQ ID NO: 330 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAACITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGCFELKENDRIFVSVTNEHLIDMDHEASFFGAFLVG

SEQ ID NO: 331 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAACITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGICELKENDRIFVSVTNEHLIDMDHEASFFGAFLVG

SEQ ID NO: 332 - protein, 281 aa, Artificial Sequence; identical to SEQ ID NO: 330
  Synthetic Construct

SEQ ID NO: 333 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 334 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFACLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 335 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGCAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 336 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHCLMKGGSTKYWSGNSEFHFYSINVGGFFKLRSGEEISIEVSNPSLLDPDQDATYFGAFKVRDID

SEQ ID NO: 337 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLCKGGSTKYWSGNSEFHFYSINVGGFFKLRSGEEISIEVSNPSLLDPDQDATYFGAFKVRDID

SEQ ID NO: 338 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMCGGSTKYWSGNSEFHFYSINVGGFFKLRSGEEISIEVSNPSLLDPDQDATYFGAFKVRDID

SEQ ID NO: 339 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKCGSTKYWSGNSEFHFYSINVGGFFKLRSGEEISIEVSNPSLLDPDQDATYFGAFKVRDID

SEQ ID NO: 340 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGCSTKYWSGNSEFHFYSINVGGFFKLRSGEEISIEVSNPSLLDPDQDATYFGAFKVRDID

SEQ ID NO: 341 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGCTKYWSGNSEFHFYSINVGGFFKLRSGEEISIEVSNPSLLDPDQDATYFGAFKVRDID

SEQ ID NO: 342 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYCSGNSEFHFYSINVGGFFKLRSGEEISIEVSNPSLLDPDQDATYFGAFKVRDID

SEQ ID NO: 343 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSCNSEFHFYSINVGGFFKLRSGEEISIEVSNPSLLDPDQDATYFGAFKVRDID

SEQ ID NO: 344 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFCFYSINVGGFFKLRSGEEISIEVSNPSLLDPDQDATYFGAFKVRDID

SEQ ID NO: 345 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHCYSINVGGFFKLRSGEEISIEVSNPSLLDPDQDATYFGAFKVRDID

SEQ ID NO: 346 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYCINVGGFFKLRSGEEISIEVSNPSLLDPDQDATYFGAFKVRDID

SEQ ID NO: 347 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGCFKLRSGEEISIEVSNPSLLDPDQDATYFGAFKVRDID

SEQ ID NO: 348 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFCKLRSGEEISIEVSNPSLLDPDQDATYFGAFKVRDID

SEQ ID NO: 349 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDCDATYFGAFKVRDID

SEQ ID NO: 350 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQCATYFGAFKVRDID

SEQ ID NO: 351 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDCTYFGAFKVRDID

SEQ ID NO: 352 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHCLMKGGSTKYWSGNSEFHFYSINVGGFFKLRSGEEISIEVSNPSLLDPDCDATYFGAFKVRDID

SEQ ID NO: 353 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHCLMKGGSTKYWSGNSEFHFYSINVGGFFKLRSGEEISIEVSNPSLLDPDQCATYFGAFKVRDID

SEQ ID NO: 354 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTCMKGGSTKYWSGNSEFHFYSINVGGFFKLRSGEEISIEVSNPSLLDPDCDATYFGAFKVRDID

SEQ ID NO: 355 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTCMKGGSTKYWSGNSEFHFYSINVGGFFKLRSGEEISIEVSNPSLLDPDQCATYFGAFKVRDID

SEQ ID NO: 356 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLCKGGSTKYWSGNSEFHFYSINVGGFFKLRSGEEISIEVSNPSLLDPDCDATYFGAFKVRDID

SEQ ID NO: 357 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMCGGSTKYWSGNSEFHFYSINVGGFFKLRSGEEISIEVSNPSLLDPDCDATYFGAFKVRDID

SEQ ID NO: 358 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMCGGSTKYWSGNSEFHFYSINVGGFFKLRSGEEISIEVSNPSLLDPDQCATYFGAFKVRDID

SEQ ID NO: 359 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMCGGSTKYWSGNSEFHFYSINVGGFFKLRSGEEISIEVSNPSLLDPDQDCTYFGAFKVRDID

SEQ ID NO: 360 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKCGSTKYWSGNSEFHFYCINVGGFFKLRSGEEISIEVSNPSLLDPDQDATYFGAFKVRDID

SEQ ID NO: 361 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGCSTKYWSGNSEFHCYSINVGGFFKLRSGEEISIEVSNPSLLDPDQDATYFGAFKVRDID

SEQ ID NO: 362 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGCSTKYWSGNSEFHFYCINVGGFFKLRSGEEISIEVSNPSLLDPDQDATYFGAFKVRDID

SEQ ID NO: 363 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGCTKYWSGNSEFCFYSINVGGFFKLRSGEEISIEVSNPSLLDPDQDATYFGAFKVRDID

SEQ ID NO: 364 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGCTKYWSGNSEFHCYSINVGGFFKLRSGEEISIEVSNPSLLDPDQDATYFGAFKVRDID

SEQ ID NO: 365 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYCSCNSEFHFYSINVGGFFKLRSGEEISIEVSNPSLLDPDQDATYFGAFKVRDID

SEQ ID NO: 366 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFACLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGCFKLRSGEEISIEVSNPSLLDPDQDATYFGAFKVRDID

SEQ ID NO: 367 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFACLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFCKLRSGEEISIEVSNPSLLDPDQDATYFGAFKVRDID

SEQ ID NO: 368 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGCAKISNMTFSNGKLIVNQDGFYYLYANICFRHHETSGDLATEYLQLMVYVTKTSIKIPSSHTLMKGGSTKYWSGNSEFHFYSINVGGFCKLRSGEEISIEVSNPSLLDPDQDATYFGAFKVRDID

SEQ ID NO: 369 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 370 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVCALRCLEEFSATAASSLGPQLRLCQVSGLLALRPGSSLRIRTLPWAHLKAAPFLTYFGLFQVH

SEQ ID NO: 371 - protein, 249 aa, Artificial Sequence
  Synthethic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLCLRCLEEFSATAASSLGPQLRLCQVSGLLALRPGSSLRIRTLPWAHLKAAPFLTYFGLFQVH

SEQ ID NO: 372 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLACRCLEEFSATAASSLGPQLRLCQVSGLLALRPGSSLRIRTLPWAHLKAAPFLTYFGLFQVH

SEQ ID NO: 373 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALCCLEEFSATAASSLGPQLRLCQVSGLLALRPGSSLRIRTLPWAHLKAAPFLTYFGLFQVH

SEQ ID NO: 374 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCCEEFSATAASSLGPQLRLCQVSGLLALRPGSSLRIRTLPWAHLKAAPFLTYFGLFQVH

SEQ ID NO: 375 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLCEFSATAASSLGPQLRLCQVSGLLALRPGSSLRIRTLPWAHLKAAPFLTYFGLFQVH

SEQ ID NO: 376 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLECFSATAASSLGPQLRLCQVSGLLALRPGSSLRIRTLPWAHLKAAPFLTYFGLFQVH

SEQ ID NO: 377 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPCLRLCQVSGLLALRPGSSLRIRTLPWAHLKAAPFLTYFGLFQVH

SEQ ID NO: 378 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQCRLCQVSGLLALRPGSSLRIRTLPWAHLKAAPFLTYFGLFQVH

SEQ ID NO: 379 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRCCQVSGLLALRPGSSLRIRTLPWAHLKAAPFLTYFGLFQVH

SEQ ID NO: 380 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLCLCQVSGLLALRPGSSLRIRTLPWAHLKAAPFLTYFGLFQVH

SEQ ID NO: 381 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVCGLLALRPGSSLRIRTLPWAHLKAAPFLTYFGLFQVH

SEQ ID NO: 382 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAACFLTYFGLFQVH

SEQ ID NO: 383 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPCLTYFGLFQVH

SEQ ID NO: 384 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFCTYFGLFQVH

SEQ ID NO: 385 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVCALRCLEEFSATAASSLGPQLRLCQVSGLLALRPGSSLRIRTLPWAHLKAACFLTYFGLFQVH

SEQ ID NO: 386 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVCALRCLEEFSATAASSLGPQLRLCQVSGLLALRPGSSLRIRTLPWAHLKAAPCLTYFGLFQVH

SEQ ID NO: 387 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLCLRCLEEFSATAASSLGPQLRLCQVSGLLALRPGSSLRIRTLPWAHLKAACFLTYFGLFQVH

SEQ ID NO: 388 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLCLRCLEEFSATAASSLGPQLRLCQVSGLLALRPGSSLRIRTLPWAHLKAAPCLTYFGLFQVH

SEQ ID NO: 389 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLACRCLEEFSATAASSLGPQLRLCQVSGLLALRPGSSLRIRTLPWAHLKAACFLTYFGLFQVH

SEQ ID NO: 390 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALCCLEEFSATAASSLGPQLRLCQVSGLLALRPGSSLRIRTLPWAHLKAACFLTYFGLFQVH

SEQ ID NO: 391 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALCCLEEFSATAASSLGPQLRLCQVSGLLALRPGSSLRIRTLPWAHLKAAPCLTYFGLFQVH

SEQ ID NO: 392 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALCCLEEFSATAASSLGPQLRLCQVSGLLALRPGSSLRIRTLPWAHLKAAPFCTYFGLFQVH

SEQ ID NO: 393 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCCEEFSATAASSLGPQCRLCQVSGLLALRPGSSLRIRTLPWAHLKAAPFLTYFGLFQVH

SEQ ID NO: 394 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCCEEFSATAASSLGPQLRCCQVSGLLALRPGSSLRIRTLPWAHLKAAPFLTYFGLFQVH

SEQ ID NO: 395 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLCEFSATAASSLGPQLCLCQVSGLLALRPGSSLRIRTLPWAHLKAAPFLTYFGLFQVH

SEQ ID NO: 396 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLECFSATAASSLGPCLRLCQVSGLLALRPGSSLRIRTLPWAHLKAAPFLTYFGLFQVH

SEQ ID NO: 397 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLECFSATAASSLGPQCRLCQVSGLLALRPGSSLRIRTLPWAHLKAAPFLTYFGLFQVH

SEQ ID NO: 398 - protein, 250 aa, Homo sapiens [sequence omitted]

SEQ ID NO: 399 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLCLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 400 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATCKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 401 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPCLRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 402 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQECLFRCIRSMPSHPDRAYNSCYSAGVFHLHQGDILSVIIPRARAKLNLSPHGTFLGFVKL

SEQ ID NO: 403 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETCFRCIRSMPSHPDRAYNSCYSAGVFHLHQGDILSVIIPRARAKLNLSPHGTFLGFVKL

SEQ ID NO: 404 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLCRCIRSMPSHPDRAYNSCYSAGVFHLHQGDILSVIIPRARAKLNLSPHGTFLGFVKL

SEQ ID NO: 405 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFCCIRSMPSHPDRAYNSCYSAGVFHLHQGDILSVIIPRARAKLNLSPHGTFLGFVKL

SEQ ID NO: 406 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCCRSMPSHPDRAYNSCYSAGVFHLHQGDILSVIIPRARAKLNLSPHGTFLGFVKL

SEQ ID NO: 407 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCICSMPSHPDRAYNSCYSAGVFHLHQGDILSVIIPRARAKLNLSPHGTFLGFVKL

SEQ ID NO: 408 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRCMPSHPDRAYNSCYSAGVFHLHQGDILSVIIPRARAKLNLSPHGTFLGFVKL

SEQ ID NO: 409 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRCYNSCYSAGVFHLHQGDILSVIIPRARAKLNLSPHGTFLGFVKL

SEQ ID NO: 410 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRACNSCYSAGVFHLHQGDILSVIIPRARAKLNLSPHGTFLGFVKL

SEQ ID NO: 411 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNCCYSAGVFHLHQGDILSVIIPRARAKLNLSPHGTFLGFVKL

SEQ ID NO: 412 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSSYSAGVFHLHQGDILSVIIPRARAKLNLSPHGTFLGFVKL

SEQ ID NO: 413 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGCFHLHQGDILSVIIPRARAKLNLSPHGTFLGFVKL

SEQ ID NO: 414 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVCHLHQGDILSVIIPRARAKLNLSPHGTFLGFVKL

SEQ ID NO: 415 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSCHGTFLGFVKL

SEQ ID NO: 416 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPCGTFLGFVKL

SEQ ID NO: 417 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHCTFLGFVKL

SEQ ID NO: 418 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQECLFRCIRSMPSHPDRAYNSCYSAGVFHLHQGDILSVIIPRARAKLNLSCHGTFLGFVKL

SEQ ID NO: 419 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQECLFRCIRSMPSHPDRAYNSCYSAGVFHLHQGDILSVIIPRARAKLNLSPCGTFLGFVKL

SEQ ID NO: 420 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETCFRCIRSMPSHPDRAYNSCYSAGVFHLHQGDILSVIIPRARAKLNLSCHGTFLGFVKL

SEQ ID NO: 421 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETCFRCIRSMPSHPDRAYNSCYSAGVFHLHQGDILSVIIPRARAKLNLSPCGTFLGFVKL

SEQ ID NO: 422 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLCRCIRSMPSHPDRAYNSCYSAGVFHLHQGDILSVIIPRARAKLNLSCHGTFLGFVKL

SEQ ID NO: 423 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFCCIRSMPSHPDRAYNSCYSAGVFHLHQGDILSVIIPRARAKLNLSCHGTFLGFVKL

SEQ ID NO: 424 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFCCIRSMPSHPDRAYNSCYSAGVFHLHQGDILSVIIPRARAKLNLSPCGTFLGFVKL

SEQ ID NO: 425 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFCCIRSMPSHPDRAYNSCYSAGVFHLHQGDILSVIIPRARAKLNLSPHCTFLGFVKL

SEQ ID NO: 426 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNCSYSAGVFHLHQGDILSVIIPRARAKLNLSPHGTFLGFVKL

SEQ ID NO: 427 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCCRSMPSHPDRACNSCYSAGVFHLHQGDILSVIIPRARAKLNLSPHGTFLGFVKL

SEQ ID NO: 428 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCCRSMPSHPDRAYNCCYSAGVFHLHQGDILSVIIPRARAKLNLSPHGTFLGFVKL

SEQ ID NO: 429 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCICSMPSHPDRACNSCYSAGVFHLHQGDILSVIIPRARAKLNLSPHGTFLGFVKL

SEQ ID NO: 430 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRCMPSHPDRCYNSCYSAGVFHLHQGDILSVIIPRARAKLNLSPHGTFLGFVKL

SEQ ID NO: 431 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRCMPSHPDRACNSCYSAGVFHLHQGDILSVIIPRARAKLNLSPHGTFLGFVKL

SEQ ID NO: 432 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLCLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGCFHLHQGDILSVIIPRARAKLNLSPHGTFLGFVKL

SEQ ID NO: 433 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLCLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVCHLHQGDILSVIIPRARAKLNLSPHGTFLGFVKL

SEQ ID NO: 434 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATCKDDSDVTEVMWQPCLRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 435 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 436 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLCLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 437 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVCLFRCIQNMPETLPNNSCYSAGIAKLEEGDELQLAIPRENAQISLDGDVTFFGALKLL

SEQ ID NO: 438 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTCFRCIQNMPETLPNNSCYSAGIAKLEEGDELQLAIPRENAQISLDGDVTFFGALKLL

SEQ ID NO: 439 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLCRCIQNMPETLPNNSCYSAGIAKLEEGDELQLAIPRENAQISLDGDVTFFGALKLL

SEQ ID NO: 440 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFCCIQNMPETLPNNSCYSAGIAKLEEGDELQLAIPRENAQISLDGDVTFFGALKLL

SEQ ID NO: 441 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCCQNMPETLPNNSCYSAGIAKLEEGDELQLAIPRENAQISLDGDVTFFGALKLL

SEQ ID NO: 442 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCICNMPETLPNNSCYSAGIAKLEEGDELQLAIPRENAQISLDGDVTFFGALKLL

SEQ ID NO: 443 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQCMPETLPNNSCYSAGIAKLEEGDELQLAIPRENAQISLDGDVTFFGALKLL

SEQ ID NO: 444 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLCNNSCYSAGIAKLEEGDELQLAIPRENAQISLDGDVTFFGALKLL

SEQ ID NO: 445 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPCNSCYSAGIAKLEEGDELQLAIPRENAQISLDGDVTFFGALKLL

SEQ ID NO: 446 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNCCYSAGIAKLEEGDELQLAIPRENAQISLDGDVTFFGALKLL

SEQ ID NO: 447 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGCAKLEEGDELQLAIPRENAQISLDGDVTFFGALKLL

SEQ ID NO: 448 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGICKLEEGDELQLAIPRENAQISLDGDVTFFGALKLL

SEQ ID NO: 449 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDCDVTFFGALKLL

SEQ ID NO: 450 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGCVTFFGALKLL

SEQ ID NO: 451 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDCTFFGALKLL

SEQ ID NO: 452 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVCLFRCIQNMPETLPNNSCYSAGIAKLEEGDELQLAIPRENAQISLDCDVTFFGALKLL

SEQ ID NO: 453 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVCLFRCIQNMPETLPNNSCYSAGIAKLEEGDELQLAIPRENAQISLDGCVTFFGALKLL

SEQ ID NO: 454 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTCFRCIQNMPETLPNNSCYSAGIAKLEEGDELQLAIPRENAQISLDCDVTFFGALKLL

SEQ ID NO: 455 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTCFRCIQNMPETLPNNSCYSAGIAKLEEGDELQLAIPRENAQISLDGCVTFFGALKLL

SEQ ID NO: 456 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLCRCIQNMPETLPNNSCYSAGIAKLEEGDELQLAIPRENAQISLDCDVTFFGALKLL

SEQ ID NO: 457 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFCCIQNMPETLPNNSCYSAGIAKLEEGDELQLAIPRENAQISLDCDVTFFGALKLL

SEQ ID NO: 458 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFCCIQNMPETLPNNSCYSAGIAKLEEGDELQLAIPRENAQISLDGCVTFFGALKLL

SEQ ID NO: 459 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFCCIQNMPETLPNNSCYSAGIAKLEEGDELQLAIPRENAQISLDGDCTFFGALKLL

SEQ ID NO: 460 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCCQNMPETLPCNSCYSAGIAKLEEGDELQLAIPRENAQISLDGDVTFFGALKLL

SEQ ID NO: 461 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCCQNMPETLPNNCCYSAGIAKLEEGDELQLAIPRENAQISLDGDVTFFGALKLL

SEQ ID NO: 462 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCICNMPETLPCNSCYSAGIAKLEEGDELQLAIPRENAQISLDGDVTFFGALKLL

SEQ ID NO: 463 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQCMPETLCNNSCYSAGIAKLEEGDELQLAIPRENAQISLDGDVTFFGALKLL

SEQ ID NO: 464 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQCMPETLPCNSCYSAGIAKLEEGDELQLAIPRENAQISLDGDVTFFGALKLL

SEQ ID NO: 465 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLCLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGCAKLEEGDELQLAIPRENAQISLDGDVTFFGALKLL

SEQ ID NO: 466 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLCLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGICKLEEGDELQLAIPRENAQISLDGDVTFFGALKLL

SEQ ID NO: 467 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 468 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAACLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 469 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGCAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 470 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELCLLVSQQSPCGRATSSSRVWWDSSFLGGVVHLEAGEKVVVRVLDERLVRLRDGTRSYFGAFMV

SEQ ID NO: 471 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELECLVSQQSPCGRATSSSRVWWDSSFLGGVVHLEAGEKVVVRVLDERLVRLRDGTRSYFGAFMV

SEQ ID NO: 472 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELCVSQQSPCGRATSSSRVWWDSSFLGGVVHLEAGEKVVVRVLDERLVRLRDGTRSYFGAFMV

SEQ ID NO: 473 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLCSQQSPCGRATSSSRVWWDSSFLGGVVHLEAGEKVVVRVLDERLVRLRDGTRSYFGAFMV

SEQ ID NO: 474 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVCQQSPCGRATSSSRVWWDSSFLGGVVHLEAGEKVVVRVLDERLVRLRDGTRSYFGAFMV

SEQ ID NO: 475 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSCQSPCGRATSSSRVWWDSSFLGGVVHLEAGEKVVVRVLDERLVRLRDGTRSYFGAFMV

SEQ ID NO: 476 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQCSPCGRATSSSRVWWDSSFLGGVVHLEAGEKVVVRVLDERLVRLRDGTRSYFGAFMV

SEQ ID NO: 477 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQCPCGRATSSSRVWWDSSFLGGVVHLEAGEKVVVRVLDERLVRLRDGTRSYFGAFMV

SEQ ID NO: 478 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCCRATSSSRVWWDSSFLGGVVHLEAGEKVVVRVLDERLVRLRDGTRSYFGAFMV

SEQ ID NO: 479 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRACSSSRVWWDSSFLGGVVHLEAGEKVVVRVLDERLVRLRDGTRSYFGAFMV

SEQ ID NO: 480 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVCWDSSFLGGVVHLEAGEKVVVRVLDERLVRLRDGTRSYFGAFMV

SEQ ID NO: 481 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWCDSSFLGGVVHLEAGEKVVVRVLDERLVRLRDGTRSYFGAFMV

SEQ ID NO: 482 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDCSFLGGVVHLEAGEKVVVRVLDERLVRLRDGTRSYFGAFMV

SEQ ID NO: 483 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGCVHLEAGEKVVVRVLDERLVRLRDGTRSYFGAFMV

SEQ ID NO: 484 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVCHLEAGEKVVVRVLDERLVRLRDGTRSYFGAFMV

SEQ ID NO: 485 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDCTRSYFGAFMV

SEQ ID NO: 486 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGCRSYFGAFMV

SEQ ID NO: 487 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTCSYFGAFMV

SEQ ID NO: 488 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELCLLVSQQSPCGRATSSSRVWWDSSFLGGVVHLEAGEKVVVRVLDERLVRLRDCTRSYFGAFMV

SEQ ID NO: 489 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELCLLVSQQSPCGRATSSSRVWWDSSFLGGVVHLEAGEKVVVRVLDERLVRLRDGCRSYFGAFMV

SEQ ID NO: 490 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELECLVSQQSPCGRATSSSRVWWDSSFLGGVVHLEAGEKVVVRVLDERLVRLRDCTRSYFGAFMV

SEQ ID NO: 491 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELECLVSQQSPCGRATSSSRVWWDSSFLGGVVHLEAGEKVVVRVLDERLVRLRDGCRSYFGAFMV

SEQ ID NO: 492 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELCVSQQSPCGRATSSSRVWWDSSFLGGVVHLEAGEKVVVRVLDERLVRLRDCTRSYFGAFMV

SEQ ID NO: 493 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLCSQQSPCGRATSSSRVWWDSSFLGGVVHLEAGEKVVVRVLDERLVRLRDCTRSYFGAFMV

SEQ ID NO: 494 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLCSQQSPCGRATSSSRVWWDSSFLGGVVHLEAGEKVVVRVLDERLVRLRDGCRSYFGAFMV

SEQ ID NO: 495 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLCSQQSPCGRATSSSRVWWDSSFLGGVVHLEAGEKVVVRVLDERLVRLRDGTCSYFGAFMV

SEQ ID NO: 496 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVCQQSPCGRATSSSRVWWDCSFLGGVVHLEAGEKVVVRVLDERLVRLRDGTRSYFGAFMV

SEQ ID NO: 497 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSCQSPCGRATSSSRVWCDSSFLGGVVHLEAGEKVVVRVLDERLVRLRDGTRSYFGAFMV

SEQ ID NO: 498 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSCQSPCGRATSSSRVWWDCSFLGGVVHLEAGEKVVVRVLDERLVRLRDGTRSYFGAFMV

SEQ ID NO: 499 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQCSPCGRATSSSRVWCDSSFLGGVVHLEAGEKVVVRVLDERLVRLRDGTRSYFGAFMV

SEQ ID NO: 500 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQCPCGRATSSSRVCWDSSFLGGVVHLEAGEKVVVRVLDERLVRLRDGTRSYFGAFMV

SEQ ID NO: 501 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQCPCGRATSSSRVWCDSSFLGGVVHLEAGEKVVVRVLDERLVRLRDGTRSYFGAFMV

SEQ ID NO: 502 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCCRACSSSRVWWDSSFLGGVVHLEAGEKVVVRVLDERLVRLRDGTRSYFGAFMV

SEQ ID NO: 503 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAACLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGCVHLEAGEKVVVRVLDERLVRLRDGTRSYFGAFMV

SEQ ID NO: 504 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAACLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVCHLEAGEKVVVRVLDERLVRLRDGTRSYFGAFMV

SEQ ID NO: 505 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGCAFLRGLSYHDGALVVTKAGYYYIYSKVQLGGVGCPLGLASTITHGLYKRTPRYPEELELLVSQQSPCGRATSSSRVWWDSSFLGGVCHLEAGEKVVVRVLDERLVRLRDGTRSYFGAFMV

SEQ ID NO: 506 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 507 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRACLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 508 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGCAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 509 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTCLLMGTKSVCEVGSNWFQPIYLGAMFSLQEGDKLMVNVSDISLVDYTKEDKTFFGAFLL

SEQ ID NO: 510 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQCLMGTKSVCEVGSNWFQPIYLGAMFSLQEGDKLMVNVSDISLVDYTKEDKTFFGAFLL

SEQ ID NO: 511 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLCMGTKSVCEVGSNWFQPIYLGAMFSLQEGDKLMVNVSDISLVDYTKEDKTFFGAFLL

SEQ ID NO: 512 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLCGTKSVCEVGSNWFQPIYLGAMFSLQEGDKLMVNVSDISLVDYTKEDKTFFGAFLL

SEQ ID NO: 513 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMCTKSVCEVGSNWFQPIYLGAMFSLQEGDKLMVNVSDISLVDYTKEDKTFFGAFLL

SEQ ID NO: 514 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGCKSVCEVGSNWFQPIYLGAMFSLQEGDKLMVNVSDISLVDYTKEDKTFFGAFLL

SEQ ID NO: 515 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTCSVCEVGSNWFQPIYLGAMFSLQEGDKLMVNVSDISLVDYTKEDKTFFGAFLL

SEQ ID NO: 516 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKCVCEVGSNWFQPIYLGAMFSLQEGDKLMVNVSDISLVDYTKEDKTFFGAFLL

SEQ ID NO: 517 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNCFQPIYLGAMFSLQEGDKLMVNVSDISLVDYTKEDKTFFGAFLL

SEQ ID NO: 518 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWCQPIYLGAMFSLQEGDKLMVNVSDISLVDYTKEDKTFFGAFLL

SEQ ID NO: 519 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQCIYLGAMFSLQEGDKLMVNVSDISLVDYTKEDKTFFGAFLL

SEQ ID NO: 520 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGACFSLQEGDKLMVNVSDISLVDYTKEDKTFFGAFLL

SEQ ID NO: 521 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMCSLQEGDKLMVNVSDISLVDYTKEDKTFFGAFLL

SEQ ID NO: 522 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKCDKTFFGAFLL

SEQ ID NO: 523 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKECKTFFGAFLL

SEQ ID NO: 524 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDCTFFGAFLL

SEQ ID NO: 525 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTCLLMGTKSVCEVGSNWFQPIYLGAMFSLQEGDKLMVNVSDISLVDYTKCDKTFFGAFLL

SEQ ID NO: 526 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTCLLMGTKSVCEVGSNWFQPIYLGAMFSLQEGDKLMVNVSDISLVDYTKECKTFFGAFLL

SEQ ID NO: 527 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQCLMGTKSVCEVGSNWFQPIYLGAMFSLQEGDKLMVNVSDISLVDYTKCDKTFFGAFLL

SEQ ID NO: 528 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQCLMGTKSVCEVGSNWFQPIYLGAMFSLQEGDKLMVNVSDISLVDYTKECKTFFGAFLL

SEQ ID NO: 529 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLCMGTKSVCEVGSNWFQPIYLGAMFSLQEGDKLMVNVSDISLVDYTKCDKTFFGAFLL

SEQ ID NO: 530 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLCGTKSVCEVGSNWFQPIYLGAMFSLQEGDKLMVNVSDISLVDYTKCDKTFFGAFLL

SEQ ID NO: 531 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLCGTKSVCEVGSNWFQPIYLGAMFSLQEGDKLMVNVSDISLVDYTKECKTFFGAFLL

SEQ ID NO: 532 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLCGTKSVCEVGSNWFQPIYLGAMFSLQEGDKLMVNVSDISLVDYTKEDCTFFGAFLL

SEQ ID NO: 533 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMCTKSVCEVGSNWFQCIYLGAMFSLQEGDKLMVNVSDISLVDYTKEDKTFFGAFLL

SEQ ID NO: 534 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGCKSVCEVGSNWCQPIYLGAMFSLQEGDKLMVNVSDISLVDYTKEDKTFFGAFLL

SEQ ID NO: 535 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGCKSVCEVGSNWFQCIYLGAMFSLQEGDKLMVNVSDISLVDYTKEDKTFFGAFLL

SEQ ID NO: 536 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTCSVCEVGSNWCQPIYLGAMFSLQEGDKLMVNVSDISLVDYTKEDKTFFGAFLL

SEQ ID NO: 537 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKCVCEVGSNCFQPIYLGAMFSLQEGDKLMVNVSDISLVDYTKEDKTFFGAFLL

SEQ ID NO: 538 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKCVCEVGSNWCQPIYLGAMFSLQEGDKLMVNVSDISLVDYTKEDKTFFGAFLL

SEQ ID NO: 539 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRACLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGACFSLQEGDKLMVNVSDISLVDYTKEDKTFFGAFLL

SEQ ID NO: 540 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRACLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMCSLQEGDKLMVNVSDISLVDYTKEDKTFFGAFLL

SEQ ID NO: 541 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGCAFTKNRMNYTNKFLLIPESGDYFIYSQVTFRGMTSECSEIRQAGRPNKPDSITVVITKVTDSYPEPTQLLMGTKSVCEVGSNWFQPIYLGAMCSLQEGDKLMVNVSDISLVDYTKEDKTFFGAFLL

SEQ ID NO: 542 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 543 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMACFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 544 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQCLTNKSKIQNVGGTYELHVGDTIDLIFNSEHQVLKNNTYWGIILLANPQFIS

SEQ ID NO: 545 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTCTNKSKIQNVGGTYELHVGDTIDLIFNSEHQVLKNNTYWGIILLANPQFIS

SEQ ID NO: 546 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNCTYWGIILLANPQFIS

SEQ ID NO: 547 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLCNKSKIQNVGGTYELHVGDTIDLIFNSEHQVLKNNTYWGIILLANPQFIS

SEQ ID NO: 548 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTCKSKIQNVGGTYELHVGDTIDLIFNSEHQVLKNNTYWGIILLANPQFIS

SEQ ID NO: 549 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNCSKIQNVGGTYELHVGDTIDLIFNSEHQVLKNNTYWGIILLANPQFIS

SEQ ID NO: 550 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKCKIQNVGGTYELHVGDTIDLIFNSEHQVLKNNTYWGIILLANPQFIS

SEQ ID NO: 551 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKCQNVGGTYELHVGDTIDLIFNSEHQVLKNNTYWGIILLANPQFIS

SEQ ID NO: 552 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGCYELHVGDTIDLIFNSEHQVLKNNTYWGIILLANPQFIS

SEQ ID NO: 553 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTCELHVGDTIDLIFNSEHQVLKNNTYWGIILLANPQFIS

SEQ ID NO: 554 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQCLTNKSKIQNVGGTYELHVGDTIDLIFNSEHQVLKNCTYWGIILLANPQFIS

SEQ ID NO: 555 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTCTNKSKCQNVGGTYELHVGDTIDLIFNSEHQVLKNNTYWGIILLANPQFIS

SEQ ID NO: 556 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLCNKCKIQNVGGTYELHVGDTIDLIFNSEHQVLKNNTYWGIILLANPQFIS

SEQ ID NO: 557 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLCNKSKCQNVGGTYELHVGDTIDLIFNSEHQVLKNNTYWGIILLANPQFIS

SEQ ID NO: 558 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTCKCKIQNVGGTYELHVGDTIDLIFNSEHQVLKNNTYWGIILLANPQFIS

SEQ ID NO: 559 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNCCKIQNVGGTYELHVGDTIDLIFNSEHQVLKNNTYWGIILLANPQFIS

SEQ ID NO: 560 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMACFGPLPSKWQMASSEPPCVNKVSDWKLEILQNGLYLIYGQVAPNANYNDVAPFEVRLYKNKDMIQTLTNKSKIQNVGGCYELHVGDTIDLIFNSEHQVLKNNTYWGIILLANPQFIS

SEQ ID NO: 561 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMACFGPLPSKWQMASSEPPCVNKVSDWKLEILQNGLYLIYGQVAPNANYNDVAPFEVRLYKNKDMIQTLTNKSKIQNVGGTCELHVGDTIDLIFNSEHQVLKNNTYWGIILLANPQFIS

SEQ ID NO: 562 - protein, 391 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 563 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRICMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 564 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKCFLQCTRSIETGKTNYNTCYTAGVCLLKARQKIAVKMVHADISINMSKHTTFFGAIRLGEAPAS

SEQ ID NO: 565 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPCLQCTRSIETGKTNYNTCYTAGVCLLKARQKIAVKMVHADISINMSKHTTFFGAIRLGEAPAS

SEQ ID NO: 566 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFCQCTRSIETGKTNYNTCYTAGVCLLKARQKIAVKMVHADISINMSKHTTFFGAIRLGEAPAS

SEQ ID NO: 567 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLCCTRSIETGKTNYNTCYTAGVCLLKARQKIAVKMVHADISINMSKHTTFFGAIRLGEAPAS

SEQ ID NO: 568 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCCRSIETGKTNYNTCYTAGVCLLKARQKIAVKMVHADISINMSKHTTFFGAIRLGEAPAS

SEQ ID NO: 569 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTCSIETGKTNYNTCYTAGVCLLKARQKIAVKMVHADISINMSKHTTFFGAIRLGEAPAS

SEQ ID NO: 570 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRCIETGKTNYNTCYTAGVCLLKARQKIAVKMVHADISINMSKHTTFFGAIRLGEAPAS

SEQ ID NO: 571 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTCYNTCYTAGVCLLKARQKIAVKMVHADISINMSKHTTFFGAIRLGEAPAS

SEQ ID NO: 572 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNCNTCYTAGVCLLKARQKIAVKMVHADISINMSKHTTFFGAIRLGEAPAS

SEQ ID NO: 573 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNCCYTAGVCLLKARQKIAVKMVHADISINMSKHTTFFGAIRLGEAPAS

SEQ ID NO: 574 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGCCLLKARQKIAVKMVHADISINMSKHTTFFGAIRLGEAPAS

SEQ ID NO: 575 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKCTTFFGAIRLGEAPAS

SEQ ID NO: 576 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHCTFFGAIRLGEAPAS

SEQ ID NO: 577 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKCFLQCTRSIETGKTNYNTCYTAGVCLLKARQKIAVKMVHADISINMSKCTTFFGAIRLGEAPAS

SEQ ID NO: 578 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPCLQCTRSIETGKTNYNTCYTAGVCLLKARQKIAVKMVHADISINMSKCTTFFGAIRLGEAPAS

SEQ ID NO: 579 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFCQCTRSIETGKTNYNTCYTAGVCLLKARQKIAVKMVHADISINMSKCTTFFGAIRLGEAPAS

SEQ ID NO: 580 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFCQCTRSIETGKTNYNTCYTAGVCLLKARQKIAVKMVHADISINMSKHCTFFGAIRLGEAPAS

SEQ ID NO: 581 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLCCTRSIETGKTNYNTCYTAGVCLLKARQKIAVKMVHADISINMSKCTTFFGAIRLGEAPAS

SEQ ID NO: 582 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLCCTRSIETGKTNYNTCYTAGVCLLKARQKIAVKMVHADISINMSKHCTFFGAIRLGEAPAS

SEQ ID NO: 583 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCCRSIETGKTNCNTCYTAGVCLLKARQKIAVKMVHADISINMSKHTTFFGAIRLGEAPAS

SEQ ID NO: 584 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCCRSIETGKTNYNCCYTAGVCLLKARQKIAVKMVHADISINMSKHTTFFGAIRLGEAPAS

SEQ ID NO: 585 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTCSIETGKTNCNTCYTAGVCLLKARQKIAVKMVHADISINMSKHTTFFGAIRLGEAPAS

SEQ ID NO: 586 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRCIETGKTCYNTCYTAGVCLLKARQKIAVKMVHADISINMSKHTTFFGAIRLGEAPAS

SEQ ID NO: 587 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRCIETGKTNCNTCYTAGVCLLKARQKIAVKMVHADISINMSKHTTFFGAIRLGEAPAS

SEQ ID NO: 588 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPACVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGCCLLKARQKIAVKMVHADISINMSKHTTFFGAIRLGEAPAS

SEQ ID NO: 589 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVCLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGCCLLKARQKIAVKMVHADISINMSKHTTFFGAIRLGEAPAS

SEQ ID NO: 590 - protein, 391 aa, Homo sapiens; identical to SEQ ID NO: 562

SEQ ID NO: 591 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPACVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 592 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVCLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 593 - protein, 391 aa, Artificial Sequence; identical to SEQ ID NO: 563
  Synthetic Construct

SEQ ID NO: 594 - protein, 391 aa, Artificial Sequence; identical to SEQ ID NO: 564
  Synthetic Construct

SEQ ID NO: 595 - protein, 391 aa, Artificial Sequence; identical to SEQ ID NO: 565
  Synthetic Construct

SEQ ID NO: 596 - protein, 391 aa, Artificial Sequence; identical to SEQ ID NO: 566
  Synthetic Construct

SEQ ID NO: 597 - protein, 391 aa, Artificial Sequence; identical to SEQ ID NO: 567
  Synthetic Construct

SEQ ID NO: 598 - protein, 391 aa, Artificial Sequence; identical to SEQ ID NO: 568
  Synthetic Construct

SEQ ID NO: 599 - protein, 391 aa, Artificial Sequence; identical to SEQ ID NO: 569
  Synthetic Construct

SEQ ID NO: 600 - protein, 391 aa, Artificial Sequence; identical to SEQ ID NO: 570
  Synthetic Construct

SEQ ID NO: 601 - protein, 391 aa, Artificial Sequence; identical to SEQ ID NO: 571
  Synthetic Construct

SEQ ID NO: 602 - protein, 391 aa, Artificial Sequence; identical to SEQ ID NO: 572
  Synthetic Construct

SEQ ID NO: 603 - protein, 391 aa, Artificial Sequence; identical to SEQ ID NO: 573
  Synthetic Construct

SEQ ID NO: 604 - protein, 391 aa, Artificial Sequence; identical to SEQ ID NO: 574
  Synthetic Construct

SEQ ID NO: 605 - protein, 391 aa, Artificial Sequence; identical to SEQ ID NO: 575
  Synthetic Construct

SEQ ID NO: 606 - protein, 391 aa, Artificial Sequence; identical to SEQ ID NO: 576
  Synthetic Construct

SEQ ID NO: 607 - protein, 391 aa, Artificial Sequence; identical to SEQ ID NO: 577
  Synthetic Construct

SEQ ID NO: 608 - protein, 391 aa, Artificial Sequence; identical to SEQ ID NO: 578
  Synthetic Construct

SEQ ID NO: 609 - protein, 391 aa, Artificial Sequence; identical to SEQ ID NO: 579
  Synthetic Construct

SEQ ID NO: 610 - protein, 391 aa, Artificial Sequence; identical to SEQ ID NO: 580
  Synthetic Construct

SEQ ID NO: 611 - protein, 391 aa, Artificial Sequence; identical to SEQ ID NO: 581
  Synthetic Construct

SEQ ID NO: 612 - protein, 391 aa, Artificial Sequence; identical to SEQ ID NO: 582
  Synthetic Construct

SEQ ID NO: 613 - protein, 391 aa, Artificial Sequence; identical to SEQ ID NO: 583
  Synthetic Construct

SEQ ID NO: 614 - protein, 391 aa, Artificial Sequence; identical to SEQ ID NO: 584
  Synthetic Construct

SEQ ID NO: 615 - protein, 391 aa, Artificial Sequence; identical to SEQ ID NO: 585
  Synthetic Construct

SEQ ID NO: 616 - protein, 391 aa, Artificial Sequence; identical to SEQ ID NO: 586
  Synthetic Construct

SEQ ID NO: 617 - protein, 391 aa, Artificial Sequence; identical to SEQ ID NO: 587
  Synthetic Construct

SEQ ID NO: 618 - protein, 391 aa, Artificial Sequence; identical to SEQ ID NO: 588
  Synthetic Construct

SEQ ID NO: 619 - protein, 391 aa, Artificial Sequence; identical to SEQ ID NO: 589
  Synthetic Construct

SEQ ID NO: 620 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAACTHSSAKPCGQQSIHLGGVFELQPGASVFVNVTDPSQVSHGTGFTSFGLLKL

SEQ ID NO: 621 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGCSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 622 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTCMKGGSTKYWSGNSEFHFYSINVGGFFKLRSGEEISIEVSNPSLLDPDQDATYFGAFKVRDID

SEQ ID NO: 623 - protein, 281 aa, Artificial Sequence; identical to SEQ ID NO: 307
  Synthetic Construct

SEQ ID NO: 624 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSCTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 625 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRCPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 626 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTCSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 627 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPCDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 628 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSECLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 629 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGCYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 630 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLICSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 631 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGCVFQLEKGDRLSAEINRPDYLDFAESGQVYFGIIAL

SEQ ID NO: 632 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFCLEKGDRLSAEINRPDYLDFAESGQVYFGIIAL

SEQ ID NO: 633 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRCPSDKPVAHVVANPQAEGQLQWLNRRANALLANGVELRDNQLVVPSEGCYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 634 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTCSDKPVAHVVANPQAEGQLQWLNRRANALLANGVELRDNQLVVPSEGCYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 635 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPCDKPVAHVVANPQAEGQLQWLNRRANALLANGVELRDNQLVVPSECLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 636 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLICSQVLFKGQGCPSTHVLLTHTISRIAVSYQTKVNLLSAIKSPCQRETPEGAEAKPWYEPIYLGCVFQLEKGDRLSAEINRPDYLDFAESGQVYFGIIAL

SEQ ID NO: 637 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSCTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFCLEKGDRLSAEINRPDYLDFAESGQVYFGIIAL

SEQ ID NO: 638 - protein, 233 aa, Artificial Sequence
  Synthetic Construct
MSTESMIRDVELAEEALPKKTGGPQGSRRCLFLSLFSFLIVAGATTLFCLLHFGVIGPQREEFPRDLSLISPLAQAVRSSSRCPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFCLEKGDRLSAEINRPDYLDFAESGQVYFGIIAL

SEQ ID NO: 639 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVCSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 640 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGCAFQLTQGDQLSTHTDGIPHLVLSPSTVFFGAFAL

SEQ ID NO: 641 - protein, 205 aa, Artificial Sequence
  Synthetic Construct
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVCSQVVFSGKAYSPKATSSPLYLAHEVQLFSSQYPFHVPLLSSQKMVYPGLQEPWLHSMYHGCAFQLTQGDQLSTHTDGIPHLVLSPSTVFFGAFAL

SEQ ID NO: 642 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLCCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 643 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGCLVQLRRGERVYVNISHPDMVDFARGKTFFGAVMVG

SEQ ID NO: 644 - protein, 244 aa, Artificial Sequence
  Synthetic Construct
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLCCLVGYRGRAPPGGGDPQGRSVTLRSSLYRAGGAYGPGTPELLLEGAETVTPVLDPARRQGYGPLWYTSVGFGCLVQLRRGERVYVNISHPDMVDFARGKTFFGAVMVG

SEQ ID NO: 645 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLICLKGYFSQEVNISLHYQKDEEPLFQLKKVRSVNSLMVASLTYKDKVYLNVTTDNTSLDDFHVNGGELILIHQNPGEFCVL

SEQ ID NO: 646 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLCVASLTYKDKVYLNVTTDNTSLDDFHVNGGELILIHQNPGEFCVL

SEQ ID NO: 647 - protein, 183 aa, Artificial Sequence
  Synthetic Construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLICLKGYFSQEVNISLHYQKDEEPLFQLKKVRSVNSLCVASLTYKDKVYLNVTTDNTSLDDFHVNGGELILIHQNPGEFCVL

SEQ ID NO: 648 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYICAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 649 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGCVFELQPGASVFVNVTDPSQVSHGTGFTSFGLLKL

SEQ ID NO: 650 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYICAQVTFCSNREASSQAPFIASLCLKSPGRFERILLRAANTHSSAKPCGQQSIHLGCVFELQPGASVFVNVTDPSQVSHGTGFTSFGLLKL

SEQ ID NO: 651 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVCSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 652 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGCVFNLTSADHLYVNVSELSLVNFEESQTFFGLYKL

SEQ ID NO: 653 - protein, 281 aa, Artificial Sequence
  Synthetic Construct
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVCSKVYFRGQSCNNLPLSHKVYMRNSKYPQDLVMMEGKMMSYCTTGQMWARSSYLGCVFNLTSADHLYVNVSELSLVNFEESQTFFGLYKL

SEQ ID NO: 654 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVCIQVTLAICSSTTASRHHPTTLAVGICSPASRSISLLRLSFHQGCTIASQRLTPLARGDTLCTNLTGTLLPSRNTDETFFGVQWVRP

SEQ ID NO: 655 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQCLTPLARGDTLCTNLTGTLLPSRNTDETFFGVQWVRP

SEQ ID NO: 656 - protein, 193 aa, Artificial Sequence
  Synthetic Construct
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVCIQVTLAICSSTTASRHHPTTLAVGICSPASRSISLLRLSFHQGCTIASQCLTPLARGDTLCTNLTGTLLPSRNTDETFFGVQWVRP

SEQ ID NO: 657 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFICCQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 658 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFCLDYLQVNTTISVNVDTFQYIDTSTFPLENVLSIFLYSNSD

SEQ ID NO: 659 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFICCQLQFLVQCPNNSVDLKLELLINKHIKKQALVTVCESGMQTKHVYQNLSQFCLDYLQVNTTISVNVDTFQYIDTSTFPLENVLSIFLYSNSD

SEQ ID NO: 660 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYICSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 661 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGCIFELKENDRIFVSVTNEHLIDMDHEASFFGAFLVG

SEQ ID NO: 662 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYICSQTYFRFQEEIKENTKNDKQMVQYIYKYTSYPDPILLMKSARNSCWSKDAEYGLYSIYQGCIFELKENDRIFVSVTNEHLIDMDHEASFFGAFLVG

SEQ ID NO: 663 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLCANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 664 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGCFFKLRSGEEISIEVSNPSLLDPDQDATYFGAFKVRDID

SEQ ID NO: 665 - protein, 317 aa, Artificial Sequence
  Synthetic Construct
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLCANICFRHHETSGDLATEYLQLMVYVTKTSIKIPSSHTLMKGGSTKYWSGNSEFHFYSINVGCFFKLRSGEEISIEVSNPSLLDPDQDATYFGAFKVRDID

SEQ ID NO: 666 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLCCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 667 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSCLLALRPGSSLRIRTLPWAHLKAAPFLTYFGLFQVH

SEQ ID NO: 668 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLCCQVHFDEGKAVYLKLDLLVDGVLALRCLEEFSATAASSLGPQLRLCQVCGLLALRPGSSLRIRTLPWAHLKAAPFLTYFGLFQVH

SEQ ID NO: 669 - protein, 249 aa, Artificial Sequence
  Synthetic Construct
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLCCQVHFDEGKAVYLKLDLLVDGVLALRCLEEFSATAASSLGPQLRLCQVSCLLALRPGSSLRIRTLPWAHLKAAPFLTYFGLFQVH

SEQ ID NO: 670 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLCSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 671 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSACVFHLHQGDILSVIIPRARAKLNLSPHGTFLGFVKL

SEQ ID NO: 672 - protein, 250 aa, Artificial Sequence
  Synthetic Construct
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLCSQVLFQDVTFTMGQVVSREGQGRQETLFRCIRSMPSHPDRAYNSCYSACVFHLHQGDILSVIIPRARAKLNLSPHGTFLGFVKL

SEQ ID NO: 673 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFICGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 674 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSACIAKLEEGDELQLAIPRENAQISLDGDVTFFGALKLL

SEQ ID NO: 675 - protein, 285 aa, Artificial Sequence
  Synthetic Construct
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFICGQVLYTDKTYAMGHLIQRKKVHVFGDELSLVTLFRCIQNMPETLPNNSCYSACIAKLEEGDELQLAIPRENAQISLDGDVTFFGALKLL

SEQ ID NO: 676 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYICSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 677 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGCVVHLEAGEKVVVRVLDERLVRLRDGTRSYFGAFMV

SEQ ID NO: 678 - protein, 240 aa, Artificial Sequence
  Synthetic Construct
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYICSKVQLGGVGCPLGLASTITHGLYKRTPRYPEELELLVSQQSPCGRATSSSRVWWDSSFLGCVVHLEAGEKVVVRVLDERLVRLRDGTRSYFGAFMV

SEQ ID NO: 679 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFICSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 680 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGCMFSLQEGDKLMVNVSDISLVDYTKEDKTFFGAFLL

SEQ ID NO: 681 - protein, 251 aa, Artificial Sequence
  Synthetic Construct
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFICSQVTFRGMTSECSEIRQAGRPNKPDSITVVITKVTDSYPEPTQLLMGTKSVCEVGSNWFQPIYLGCMFSLQEGDKLMVNVSDISLVDYTKEDKTFFGAFLL

SEQ ID NO: 682 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLICGQVAPNANYNDVAPFEVRLYKNKDMIQTLTNKSKIQNVGGTYELHVGDTIDLIFNSEHQVLKNNTYWGIILLANPQFIS

SEQ ID NO: 683 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGCTYELHVGDTIDLIFNSEHQVLKNNTYWGIILLANPQFIS

SEQ ID NO: 684 - protein, 199 aa, Artificial Sequence
  Synthetic Construct
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLICGQVAPNANYNDVAPFEVRLYKNKDMIQTLTNKSKIQNVGCTYELHVGDTIDLIFNSEHQVLKNNTYWGIILLANPQFIS

SEQ ID NO: 685 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFICSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 686 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTACVCLLKARQKIAVKMVHADISINMSKHTTFFGAIRLGEAPAS

SEQ ID NO: 687 - protein, 391 aa, Artificial Sequence
  Synthetic Construct
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFICSQVEVYYINFTDFASYEVVVDEKPFLQCTRSIETGKTNYNTCYTACVCLLKARQKIAVKMVHADISINMSKHTTFFGAIRLGEAPAS

SEQ ID NO: 688 - protein, 244 aa, Homo sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 689 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFCVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 690 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFCYHITVYMKDVKVSLFKKDKAMLFTYDQYQENNVDQASGSVLLHLEVGDQVWLQVYGEGERNGLYADNDNDSTFTGFLLYHDTN

SEQ ID NO: 691 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKCMLFTYDQYQENNVDQASGSVLLHLEVGDQVWLQVYGEGERNGLYADNDNDSTFTGFLLYHDTN

SEQ ID NO: 692 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKACLFTYDQYQENNVDQASGSVLLHLEVGDQVWLQVYGEGERNGLYADNDNDSTFTGFLLYHDTN

SEQ ID NO: 693 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMCFTYDQYQENNVDQASGSVLLHLEVGDQVWLQVYGEGERNGLYADNDNDSTFTGFLLYHDTN

SEQ ID NO: 694 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLCTYDQYQENNVDQASGSVLLHLEVGDQVWLQVYGEGERNGLYADNDNDSTFTGFLLYHDTN

SEQ ID NO: 695 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFCYDQYQENNVDQASGSVLLHLEVGDQVWLQVYGEGERNGLYADNDNDSTFTGFLLYHDTN

SEQ ID NO: 696 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTCDQYQENNVDQASGSVLLHLEVGDQVWLQVYGEGERNGLYADNDNDSTFTGFLLYHDTN

SEQ ID NO: 697 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYCQYQENNVDQASGSVLLHLEVGDQVWLQVYGEGERNGLYADNDNDSTFTGFLLYHDTN

SEQ ID NO: 698 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDCYQENNVDQASGSVLLHLEVGDQVWLQVYGEGERNGLYADNDNDSTFTGFLLYHDTN

SEQ ID NO: 699 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENCVDQASGSVLLHLEVGDQVWLQVYGEGERNGLYADNDNDSTFTGFLLYHDTN

SEQ ID NO: 700 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNCDQASGSVLLHLEVGDQVWLQVYGEGERNGLYADNDNDSTFTGFLLYHDTN

SEQ ID NO: 701 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDCASGSVLLHLEVGDQVWLQVYGEGERNGLYADNDNDSTFTGFLLYHDTN

SEQ ID NO: 702 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSCLLHLEVGDQVWLQVYGEGERNGLYADNDNDSTFTGFLLYHDTN

SEQ ID NO: 703 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVCLHLEVGDQVWLQVYGEGERNGLYADNDNDSTFTGFLLYHDTN

SEQ ID NO: 704 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNCNDSTFTGFLLYHDTN

SEQ ID NO: 705 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDCDSTFTGFLLYHDTN

SEQ ID NO: 706 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNCSTFTGFLLYHDTN

SEQ ID NO: 707 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKCMLFTYDQYQENNVDQASGSVLLHLEVGDQVWLQVYGEGERNGLYADNCNDSTFTGFLLYHDTN

SEQ ID NO: 708 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKCMLFTYDQYQENNVDQASGSVLLHLEVGDQVWLQVYGEGERNGLYADNDCDSTFTGFLLYHDTN

SEQ ID NO: 709 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKACLFTYDQYQENNVDQASGSVLLHLEVGDQVWLQVYGEGERNGLYADNCNDSTFTGFLLYHDTN

SEQ ID NO: 710 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKACLFTYDQYQENNVDQASGSVLLHLEVGDQVWLQVYGEGERNGLYADNDCDSTFTGFLLYHDTN

SEQ ID NO: 711 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMCFTYDQYQENNVDQASGSVLLHLEVGDQVWLQVYGEGERNGLYADNCNDSTFTGFLLYHDTN

SEQ ID NO: 712 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLCTYDQYQENNVDQASGSVLLHLEVGDQVWLQVYGEGERNGLYADNCNDSTFTGFLLYHDTN

SEQ ID NO: 713 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLCTYDQYQENNVDQASGSVLLHLEVGDQVWLQVYGEGERNGLYADNDCDSTFTGFLLYHDTN

SEQ ID NO: 714 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLCTYDQYQENNVDQASGSVLLHLEVGDQVWLQVYGEGERNGLYADNDNCSTFTGFLLYHDTN

SEQ ID NO: 715 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFCYDQYQENNVDCASGSVLLHLEVGDQVWLQVYGEGERNGLYADNDNDSTFTGFLLYHDTN

SEQ ID NO: 716 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTCDQYQENNCDQASGSVLLHLEVGDQVWLQVYGEGERNGLYADNDNDSTFTGFLLYHDTN

SEQ ID NO: 717 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTCDQYQENNVDCASGSVLLHLEVGDQVWLQVYGEGERNGLYADNDNDSTFTGFLLYHDTN

SEQ ID NO: 718 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYCQYQENNCDQASGSVLLHLEVGDQVWLQVYGEGERNGLYADNDNDSTFTGFLLYHDTN

SEQ ID NO: 719 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDCYQENCVDQASGSVLLHLEVGDQVWLQVYGEGERNGLYADNDNDSTFTGFLLYHDTN

SEQ ID NO: 720 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDCYQENNCDQASGSVLLHLEVGDQVWLQVYGEGERNGLYADNDNDSTFTGFLLYHDTN

SEQ ID NO: 721 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFCYHITVYMKDVKVSLFKKDKAMLFTYDQYQENNVDQASGSCLLHLEVGDQVWLQVYGEGERNGLYADNDNDSTFTGFLLYHDTN

SEQ ID NO: 722 - protein, 244 aa, Artificial Sequence
  Synthetic Construct
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFCVGLETYVTIPNMPIRFTKIFYNQQNHYDGSTGKFHCNIPGLYYFAYHITVYMKDVKVSLFKKDKAMLFTYDQYQENNVDQASGSVCLHLEVGDQVWLQVYGEGERNGLYADNDNDSTFTGFLLYHDTN

SEQ ID NO: 723 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHCSAKPCGQQSIHLGGVFELQPGASVFVNVTDPSQVSHGTGFTSFGLLKL

SEQ ID NO: 724 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSACPCGQQSIHLGGVFELQPGASVFVNVTDPSQVSHGTGFTSFGLLKL

SEQ ID NO: 725 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKCCGQQSIHLGGVFELQPGASVFVNVTDPSQVSHGTGFTSFGLLKL

SEQ ID NO: 726 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHCSACPCGQQSIHLGGVFELQPGASVFVNVTDPSQVSHGTGFTSFGLLKL

SEQ ID NO: 727 - protein, 261 aa, Artificial Sequence
  Synthetic Construct
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHCSAKCCGQQSIHLGGVFELQPGASVFVNVTDPSQVSHGTGFTSFGLLKL

SEQ ID NO: 728 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQSPNNSVDLKLELLINKHIKKQALVTVCESGMQTKHVYQNLSQFLLDYLQVNTTISVNVDTFQYIDTSTFPLENVLSIFLYSNSD

SEQ ID NO: 729 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQSPNNSVDLKLELLINKHIKKQALVTVCESGMQTKHVCQNLSQFLLDYLQVNTTISVNVDTFQYIDTSTFPLENVLSIFLYSNSD

SEQ ID NO: 730 - protein, 234 aa, Artificial Sequence
  Synthetic Construct
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQSPNNSVDLKLELLINKHIKKQALVTVCESGMQTKHVYQCLSQFLLDYLQVNTTISVNVDTFQYIDTSTFPLENVLSIFLYSNSD

SEQ ID NO: 731 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVCFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 732 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGCLLHLSAGQRLGVHLHTEARARHAWQLTQGATVLGLFRVTPEIPAGLPSPRSE

SEQ ID NO: 733 - protein, 254 aa, Artificial Sequence
  Synthetic Construct
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVCFQLELRRVVAGEGSGSVSLALHLQPLRSAAGAAALALTVDLPPASSEARNSAFGFQGCLLHLSAGQRLGVHLHTEARARHAWQLTQGATVLGLFRVTPEIPAGLPSPRSE

SEQ ID NO: 734 - protein, 281 aa, Artificial Sequence
  Synthetic Construct
MAMMEVQGGPSLGQTCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSCRNSCWSKDAEYGLYSIYQGGIFELKENDRIFVSVTNEHLIDMDHEASFFGAFLVG

SEQ ID NO: 735 - protein, 250 aa, Artificial Sequence; identical to SEQ ID NO: 426
  Synthetic Construct

The invention claimed is:

1. A trimer comprising monomers of a soluble polypeptide, wherein said soluble polypeptide comprises a tumor necrosis factor superfamily (TNFSF) ligand or TNF-like ligand, or an extracellular domain thereof, wherein at least a first said soluble polypeptide of the trimer comprises an amino acid substitution or insertion that introduces a surface-exposed, exterior-facing cysteine residue at a position in the first soluble polypeptide that is located at a natural interface between monomers of the trimer, wherein an alpha carbon (Cα) of the cysteine residue of the first soluble polypeptide is within 9 Å of a Cα of a cysteine residue of a second said soluble polypeptide of the trimer that is also located at the natural interface between the monomers of the trimer, wherein the cysteine residue of the first soluble polypeptide is disulfide bonded to the cysteine residue of the second soluble polypeptide, and wherein said TNFSF or TNF-like ligand is tumor necrosis factor-α (TNF-α), lymphotoxin-α (LT-α), lymphotoxin-β (LT-β), cluster of differentiation 40 ligand (CD40L), cluster of differentiation 70 (CD70), receptor activator of nuclear factor kappa beta ligand (RANKL), tumor necrosis family receptor superfamily member 4 ligand (OX40L), cluster of differentiation 95 ligand (FasL), tumor necrosis family receptor superfamily member 9 (4-1BB ligand), TNF-related apoptosis-inducing ligand (TRAIL), TNF-related weak inducer of apoptosis (TWEAK), a proliferation-inducing ligand (APRIL), B lymphocyte stimulator (BLys), tumor necrosis family receptor superfamily member 14 (LIGHT), TNF-like ligand 1 (TL1), glucocorticoid-induced TNF receptor ligand (GITRL), ectodysplasin A1 (EDA-A1), ectodysplasin A2 (EDA-A2), or adiponectin.

2. The hinter of claim 1, wherein at least a second surface-exposed, exterior-facing amino acid residue of said TNFSF or TNF-like ligand of said first soluble polypeptide is substituted with a cysteine residue at a natural interface between monomers of the trimer.

3. The trimer of claim 1, wherein at least said first soluble polypeptide comprises substitutions of three or four surface-exposed, exterior-facing amino acid residues of said TNFSF or TNF-like ligand with cysteine residues at a natural interface between monomers of the trimer.

4. The trimer of claim 1, wherein at least said first soluble polypeptide comprises an insertion of a cysteine residue within two separate regions of said TNFSF or TNF-like ligand comprising surface-exposed, exterior-facing amino acid residues at a natural interface between monomers of the trimer.

5. The trimer of claim 1, wherein at least said first soluble polypeptide comprises insertions of a cysteine residue within three or four separate regions of said TNFSF or TNF-like ligand comprising surface-exposed, exterior-facing amino acid residues at a natural interface between monomers of the trimer.

6. The trimer of claim 1, wherein each of the monomers comprises the same amino acid sequence.

7. The trimer of claim 1, wherein the monomers of the trimer comprise the same TNFSF or TNF-like ligand and wherein at least one or each of the monomers comprises a different amino acid sequence.

8. The trimer of claim 1, wherein each said soluble polypeptide of the trimer has at least 85% sequence identity to any one of SEQ ID NOs: 2-39 and 624-638.

9. A pharmaceutical composition comprising the trimer of claim 1 and one or more pharmaceutically acceptable carriers or excipients.

10. The trimer of claim 1, wherein said TNFSF ligand is TNF-α.

11. The trimer of claim 2, wherein said TNFSF ligand is TNF-α and the first and second surface-exposed, exterior-facing cysteine substitutions of said first polypeptide are selected from one or more of the following pairs of cysteine substitutions: G130C/S85C, L131C/T83C, L131C/P84C, S171C/G224C, N168C/S223C, N168C/G224C, L169C/S223C, 69C/G224C, L170C/S223C, S171C/S223C, S171C/Q225C, A172C/P193C, I173C/Y191C, I173C/P193C, K174C/Y191C, S175C/W190C, S175C/Y191C, Q178OE180C, G198C/Y135C, V199C/H191C, F200C/H91C, F200C/N110C, Q201C/R82C, and Q201C/T83C, relative to the amino acid sequence of SEQ ID NO: 1.

12. The trimer of claim 11, wherein said cysteine substitutions are S171C and G224C, relative to the amino acid sequence of SEQ ID NO: 1.

13. The trimer of claim 1, wherein:
(a) said TNFSF ligand is LT-α, wherein at least said first soluble polypeptide comprises one or more of the following pairs of cysteine substitutions: P147C/P195C, P147C/S196C, L148C/P195C, L148C/S196C, L149C/P195C, S150C/S196C, S150C/P195C, S150C/T197C, S151C/S166C, Q152C/L164C, Q152C/S166C, K153C/L164C, M154C/W163C, M154C/L164C, A171C/Y110C, A172C/H66C, F173C/H66C, and F173C/R85C, relative to the amino acid sequence of SEQ ID NO: 40; or
(b) said TNFSF ligand is LT-β, wherein at least said first soluble polypeptide comprises one or more of the following pairs of cysteine substitutions: L177C/R233C, L177C/G234C, L178C/R233C, L178C/G234C, L179C/R233C, E180C/R233C, E180C/G234C, E180C/K235C, G181C/S204C, A182C/Y202C, A182C/S204C, E183C/Y202C, T184C/W201C, T184C/Y202C, G209C/Y136C, L210C/H91C, V211C/H91C, and V211C/Q110C, relative to the amino acid sequence of SEQ ID NO: 76; or
(c) said TNFSF ligand is OX40 ligand (OX40L), wherein at leat said first soluble polypeptide comprises one or more of the following pairs of cysteine substitutions: P125C/N166C, L126C/N166C, Q128C/N166C, Q128C/G167C, L129C/S134C, K130C/S134C, M139C/S104C, V140C/K63C, and A141C/K63C, relative to the amino acid sequence of SEQ ID NO: 112; or
(d) said TNFSF ligand is CD40L, wherein at least said first soluble polypeptide comprises one or more of the following pairs of cysteine substitutions: I204C/T251C, I204C/G252C, L205C/T251C, L205C/G252C, L206C/T251C, R207C/T251C, R207C/G252C, R207C/F253C, A208C/S222C, A209C/Q220C, A209C/S222C, N210C/Q220C, T211C/G219C, T211C/Q220C, S213C/K216C, S213C/P217C, G227C/Y172C, V228C/H125C, F229C/H125C, and F229C/Y145C, relative to the amino acid sequence of SEQ ID NO: 132; or
(e) said TNFSF ligand is FasL, wherein at least said first soluble polypeptide comprises one or more of the following pairs of cysteine substitutions: V223C/E271C, V223C/S272C, M224C/E271C, M224C/S272C, M225C/E271C, E226C/E271C, E226C/S272C, E226C/Q273C, G227C/S242C, K228C/A240C, K228C/S242C, M229C/A240C, M230C/W239C, M230C/A240C, A247C/Y192C, V248C/H148C, F249C/H148C, and F249C/I168C, relative to the amino acid sequence of SEQ ID NO: 167; or
(f) said TNFSF ligand is CD153, wherein at least said first soluble polypeptide comprises one or more of the following pairs of cysteine substitutions: A172C/P220C, A172C/L221C, L173C/P220C, L173C/L221C, V174C/P220C, T175C/P220C, T175C/L221C, T175C/E222C, V176C/N189C, E178C/Y187C, S179C/V186C, S179C/Y187C, Y187C/C151S, N189C/C151S, L194C/I142C, L195C/Y101C, and D196C/Y101C, relative to the amino acid sequence of SEQ ID NO: 236; or
(g) said TNFSF ligand is 4-1BB ligand, wherein at least said first soluble polypeptide comprises one or more of the following pairs of cysteine substitutions: A178C/G231C, L179C/G231C, L181C/G231C, L181C/A232C, T182C/F197C, V183C/S195C, V183C/F197C, D184C/S195C, L185C/N194C, L185C/S195C, R202C/F1440, L203C/Q94C, L204C/Q94C, and L204C/L1150, relative to the amino acid sequence of SEQ ID NO: 267; or
(h) said TNFSF ligand is TRAIL, wherein at least said first soluble polypeptide comprises one or more of the following pairs of cysteine substitutions: L221C/H270C, L221C/E271C, L222C/H270C, L222C/E271C, M223C/H270C, K224C/H270C, K224C/E271C, K224C/A272C, S225C/S241C, A226C/L239C, A226C/S241C, R227C/L239C, N228C/G238C, N228C/L239C, G246C/Y185C, I247C/H125C, and L147C/H161C, relative to the amino acid sequence of SEQ ID NO: 297; or
(i) said TNFSF ligand is RANKL, wherein at least said first soluble polypeptide comprises one or more of the following pairs of cysteine substitutions: T254C/Q303C, T254C/D304C, L255C/Q303C, L255C/D304C, M256C/Q303C, K257C/Q303C, K257C/D304C, K257C/A305C, G258C/S274C, G259C/F272C, G259C/S274C, S260C/H271C, S260C/F272C, W264C/G266C, G279C/Y217C, F280C/H167C, F281C/H167C, and F281C/W193C, relative to the amino acid sequence of SEQ ID NO: 333; or
(j) said TNFSF ligand is TWEAK, wherein at least said first soluble polypeptide comprises one or more of the following pairs of cysteine substitutions: Y164C/S213C, Y164C/G214C, L187C/P238C, L187C/F239C, A188C/P238C, A188C/F239C, L189C/P238C, R190C/P238C, R190C/F239C, R190C/L240C, L192C/L207C, L192C/L209C, E193C/R208C, E194C/Q206C, and E194C/L207C, relative to the amino acid sequence of SEQ ID NO: 369; or
(k) said TNFSF ligand is APRIL, wherein at least said first soluble polypeptide comprises one or more of the following pairs of cysteine substitutions: T192C/P240C, T192C/H241C, L193C/P240C, L193C/H241C, F194C/P240C, R195C/P240C, R195C/H241C, R195C/G242C, I197C/Y208C, I197C/S210C, R198C/Y208C, S199C/A207C, S199C/Y208C, S210C/C211S, G215C/Y166C, V216C/H119C, F217C/H119C, and F127C/A141C, relative to the amino acid sequence of SEQ ID NO: 398; or
(l) said TNFSF ligand is BLys, wherein at least said first soluble polypeptide comprises one or more of the following pairs of cysteine substitutions: T228C/G274C, T228C/D275C, L229C/G274C, L229C/D275C, F230C/G274C, R231C/G2740, R231C/D275C, R231C/V276C, I233C/N242C, I233C/S244C, Q234C/N242C, N235C/P241C, N235C/N242C, G249C/Y196C, I250C/Q148C, and A251C/Q148C, relative to the amino acid sequence of SEQ ID NO: 435; or
(m) said TNFSF ligand is LIGHT, wherein at least said first soluble polypeptide comprises one or more of the following pairs of cysteine substitutions: E178C/G230C, E178C/T231C, L179C/G230C, L179C/T231C, L180C/G230C, V181C/G230C, V181C/T231C, V181C/R232C, S182C/S200C, Q183C/W198C, Q183C/S200C, Q184C/W198C, S185C/W197C, S185C/W198C, G188C/T191C, G205C/Y144C, V206C/H97C, V207C/H97C, and V207C/L120C, relative to the amino acid sequence of SEQ ID NO: 467; or
(n) said TNFSF ligand is TL1, wherein at least said first soluble polypeptide comprises one or more of the following pairs cysteine substitutions: Q193C/E241C, Q193C/D242C, L194C/E241C, L194C/D242C, L195C/E241C, M196C/E241C, M196C/D242C, M196C/K243C, G197C/P211C, T198C/F209C, T198C/P211C, K199C/F209C, S200C/W208C, S200C/F209C, A216C/Y150C, M217C/H98C, F218C/H98C, and F218C/L125C, relative to the amino acid sequence of SEQ ID NO: 506; or
(o) said TNFSF ligand is GITRL, wherein at least said first soluble polypeptide comprises one or more of the following pairs of cysteine substitutions: T148C/N184C, L149C/I155C, T150C/S153C, T150C/I155C, N151C/S153C, K152C/S153C, G160C/Y120C, T161C/K83C, and Y162C/K83C, relative to the amino acid sequence of SEQ ID NO: 542; or
(p) said TNFSF ligand is CD70, wherein at least said first soluble polypeptide comprises one or more of the following pairs of cysteine substitutions: T127C/T181C, T127C/D182C, L128C/T181C, L128C/D182C, A129C/T181C, V130C/T181C, V130C/D182C, V130C/E183C, G131C/T152C, I132C/G150C, I132C/T152C, S134C/Q149C, S134C/G150C, S137C/S139, G150C/C151S, R157C/H107C, and T159C/R83C, relative to the amino acid sequence of SEQ ID NO: 203; or
(q) said TNFSF ligand is EDA, wherein one or more of the following pairs of cysteine substitutions: P328C/H376C 577, F329C/H376C, L330C/H376C, L330C/T377C, Q331C/H376C, Q331C/T377C, T333C/Y343C, T333C/T345C, R334C/Y343C, S335C/N342C, S335C/Y3430, G350C/Y304C, V351C/V250C, and V351C/H252C, relative to the amino acid sequence of SEQ ID NO: 562 or 590; or
(r) said TNF-like ligand is adiponectin, wherein one or more of the following pairs of cysteine substitutions: A181C/D229C, A181C/N230C, M182C/D229C, M182C/N230C, L183C/D229C, F184C/D229C, F184C/N230C, F184C/D231C, T185C/Q196C, Y186C/V194C, Y186C/Q196C, D187C/V194C, Q188C/N193C, Q188C/V194C, V201C/A161C, and L202C/S1160, relative to the amino acid sequence of SEQ ID NO: 688.

14. A soluble polypeptide comprising TNF-α, wherein said soluble polypeptide comprises cysteine substitutions S171C and G224C relative to the amino acid sequence of SEQ ID NO: 1.

* * * * *